United States Patent
Trobridge et al.

(10) Patent No.: US 10,221,460 B2
(45) Date of Patent: Mar. 5, 2019

(54) METHODS AND KITS FOR THE PROGNOSIS AND TREATMENT OF PROSTATE CANCER

(71) Applicant: WASHINGTON STATE UNIVERSITY, Pullman, WA (US)

(72) Inventors: Grant D. Trobridge, Pullman, WA (US); Arun Kumar Nalla, Pullman, WA (US)

(73) Assignee: Washington State University, Pullman, WA (US)

( * ) Notice: Subject to any disclaimer, the term of this patent is extended or adjusted under 35 U.S.C. 154(b) by 63 days.

(21) Appl. No.: 15/129,841

(22) PCT Filed: Mar. 25, 2015

(86) PCT No.: PCT/US2015/022457
§ 371 (c)(1),
(2) Date: Sep. 28, 2016

(87) PCT Pub. No.: WO2015/148645
PCT Pub. Date: Oct. 1, 2015

(65) Prior Publication Data
US 2017/0183739 A1    Jun. 29, 2017

Related U.S. Application Data

(60) Provisional application No. 61/972,057, filed on Mar. 28, 2014.

(51) Int. Cl.
*G01N 33/00* (2006.01)
*C12Q 1/6886* (2018.01)
*G01N 33/574* (2006.01)

(52) U.S. Cl.
CPC ..... *C12Q 1/6886* (2013.01); *G01N 33/57434* (2013.01); *C12Q 2600/112* (2013.01); *C12Q 2600/118* (2013.01); *C12Q 2600/158* (2013.01); *G01N 2800/52* (2013.01)

(58) Field of Classification Search
None
See application file for complete search history.

(56) References Cited

U.S. PATENT DOCUMENTS

| | | |
|---|---|---|
| 2010/0137164 A1 | 6/2010 | Rubin et al. |
| 2011/0110926 A1 | 5/2011 | Luo et al. |
| 2014/0045915 A1 | 2/2014 | Skog et al. |

OTHER PUBLICATIONS

Pickova et al (FEBS letter 551:42-46, 2003). (Year: 2003).*
Schauberger et al (J Allergy Clin Immunol 128:753-60, 2011 (Year: 2011).*
Chen et al., "Gene expression in the LNCaP human prostate cancer progression model: Progression associated expression in vitro corresponds to expression changes associated with prostate cancer progression in vivo", Cancer Letters, Dec. 8, 2006, pp. 274-288, vol. 244.

* cited by examiner

*Primary Examiner* — Lei Yao
(74) *Attorney, Agent, or Firm* — W & C IP

(57) ABSTRACT

Provided herein are methods for the prognosis of prostate cancer progression in a patient by analyzing the gene expression in a tumor sample obtained from the patient the prognosis of prostate cancer progression in a patient by analyzing the gene expression in a tumor sample obtained from the patient. In particular, gene expression levels of GCOM1, MEX3D, TRPM4, ATPAF1, PTRF, GLYATL1, FLNA, OBSCN, STRA13, WHSC1, ARFGAP3, KDM2A, FAM83H, CLDN7, CNOT6, and B3GNT9 are measured. Kits containing means for the measurement of gene expression as described herein and methods for treatment of prostate cancer are also provided.

5 Claims, 11 Drawing Sheets
Specification includes a Sequence Listing.

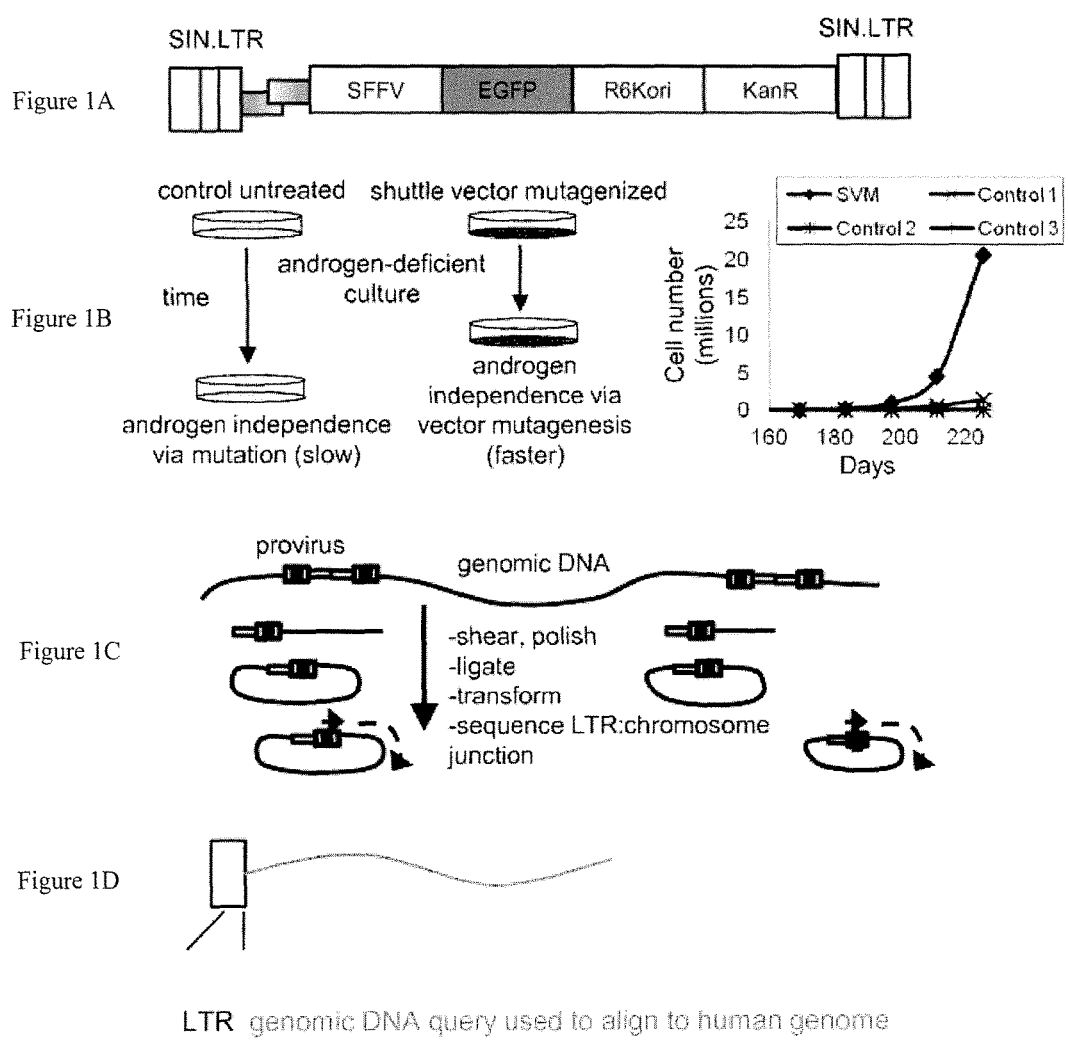

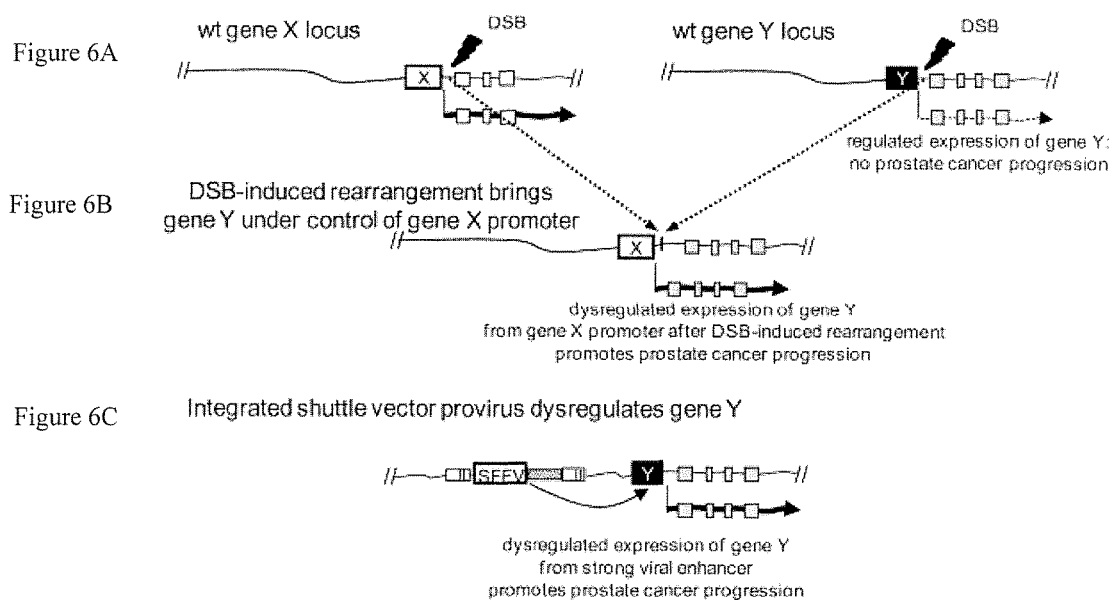

METHODS AND KITS FOR THE PROGNOSIS AND TREATMENT OF PROSTATE CANCER

PRIORITY

This application claims the benefit of U.S. application 61/972,057, filed Mar. 28, 2014. This application is incorporated herein by reference in its entirety.

STATEMENT AS TO RIGHTS TO INVENTIONS MADE UNDER FEDERALLY SPONSORED RESEARCH AND DEVELOPMENT

This invention was made with government support under R15 CA173598 awarded by the National Institutes of Health and under W81XWH-11-1-0576 awarded by the U.S. Department of Defense. The government has certain rights in the invention.

FIELD OF THE INVENTION

The invention generally relates to a method for the prognosis of prostate cancer progression in a patient by analyzing the gene expression in a sample obtained from the patient and treatments thereof.

SEQUENCE LISTING

This document incorporates by reference an electronic sequence listing text file, which was electronically submitted along with this document. The text file is named 12770028TA_ST25.txt, is 958 kilobytes, and was created on Mar. 13, 2015.

BACKGROUND OF THE INVENTION

Prostate cancer (PC) is the second most common cause of cancer related deaths in men in the United States, and is one of the leading causes of sickness and death in men in the U.S. and Western Europe [8,9]. Despite this high prevalence, the molecular mechanisms of PC progression still remain largely unknown, due in part to heterogeneity during tumor development [10]. The five year survival rate of PC is almost 100% if diagnosed early. However the rate drops to ~30% if diagnosed late or once it has metastasized to distant organs [69]. Localized primary PC is treated by prostatectomy or radiotherapy, but often patients develop metastatic disease. PC is initially androgen-dependent, making androgen deprivation therapy (ADT) the first line of defense in combating the disease [11]. Though this treatment initially reduces tumor size, almost all patients eventually develop androgen-independent prostate cancer (AIPC), which is resistant to this primary form of therapy and is ultimately lethal [11-13]. Thus, determining the mechanisms that contribute to AIPC is critical to develop novel therapies for this advanced form of PC.

Insertional mutagenesis screens using replicating retroviruses have identified many genes that contribute to cancer initiation and progression and have greatly improved our understanding of carcinogenesis (reviewed by Uren et al. [1]). These screens identify genomic loci which contain proviral integration sites that are identified from different tumors, called common insertion sites (CIS). These CISs occur because integrated retroviruses dysregulate nearby genes by a variety of mechanisms, and clones with provirus insertions near dysregulated genes that provide a selective advantage become enriched [2].

To date, the majority of insertional mutagenesis screens have utilized replicating gammaretroviruses (γRV) or transposons which have several limitations. Screens that use replicating retroviruses are limited to tissues and cell types that are permissive for replication of the virus. Because of this, the majority of screens have been performed in mouse hematopoietic cells or mouse mammary cells using replicating γRV vectors. Transposons allow mutagenesis of essentially any tissue and have expanded the use of mutagenesis screens. However, a major drawback of transposon approaches is the time it takes to generate the germline transgenic or knockout lines used, and to combine multiple alleles into the same background [3]. Another limitation of transposon mutagenesis is that multiple transposition events complicate the identification of causative mutagenic events [3].

By contrast replication-incompetent retroviruses do not replicate after integrating into the genome, and therefore do not introduce additional insertions. This reduces passenger insertions. Recent studies have used replication incompetent retroviral vectors as mutagens to identify driver genes involved in the initiation and progression of leukemia, liver, breast, pancreatic, and PC [4, 70].

High-throughput gene expression studies [40-42], comparative genome hybridization studies [43,44], and proteome studies [45-47] have previously been used to identify genes that are altered/mutated and differentially expressed between androgen sensitive and androgen insensitive PC. However, a major challenge in these high-throughput studies is differentiating driver mutations that cause cancer from passenger mutations that do not significantly contribute to the course of disease. Identifying the driver genetic mutations responsible for AIPC is critical to improve the prediction of recurrence and to contribute new therapeutics to increase the life expectancy of PC patients.

SUMMARY OF THE INVENTION

Described herein is a novel screen to identify driver genes involved in the progression to androgen-independent prostate cancer (AIPC) in human cells using a replication-incompetent HIV-based LV. This approach overcomes a major limitation of other high-throughput techniques that seek to identify driving mutations from a prostate cancer cell with other accumulated passenger genetic lesions. Sixteen driver genes that are dysregulated in prostate cancer patients were identified: ATPAF1, GCOM1, MEX3D, PTRF, TRPM4, GLYATL1, FLNA, OBSCN, STRA13, WHSC1, ARFGAP3, KDM2A, FAM83H, CLDN7, CNOT6 and B3GNT9. Ten of these genes, ATPAF1, MEX3D, TRPM4, GLYATL1, STRA13, WHSC1, ARFGAP3, FAM83H, CLDN7, and CNOT6, are over-expressed in PC tissue, while six are under-expressed, GCOM1, PTRF, OBSCN, FLNA, B3GNT6, and KDM2A. Importantly these biomarkers are highly predictive for survival of prostate cancer patients and are useful biomarkers that can be used to predict patient survival either by themselves, or in various combinations.

The biomarkers of the invention can be used for diagnosis, monitoring (i.e. monitoring progression or therapeutic treatment), prognosis, treatment (e.g. guiding treatment), or classification of prostate cancer or as biomarkers before and after surgery.

In particular, embodiments of the invention provide a method for the prognosis of prostate cancer progression in a subject, said method comprising:

a) obtaining a biological sample from said subject, b) measuring in said sample the gene expression level of at least one gene selected from the group consisting of GCOM1, MEX3D, TRPM4, ATPAF1, PTRF, GLYATL1, FLNA, OBSCN, STRA13, WHSC1, ARFGAP3, KDM2A, FAM83H, CLDN7, CNOT6 and B3GNT9 c) comparing every expression level determined at step b) with a reference value, and d) providing a good prognosis when GCOM1, PTRF, OBSCN, FLNA, B3GNT6, and/or KDM2A expression levels determined at step b) are higher than their reference values and/or MEX3D, TRPM4, ATPAF1, GLYATL1, STRA13, WHSC1, ARFGAP3, FAM83H, CLDN7, and/or CNOT6 expression levels determined at step b) are lower than their reference values, or e) providing a poor prognosis when GCOM1, PTRF, OBSCN, FLNA, B3GNT6, and/or KDM2A expression levels determined at step b) are lower than their reference values and/or MEX3D, TRPM4, ATPAF1, GLYATL1, STRA13, WHSC1, ARFGAP3, FAM83H, CLDN7, and/or CNOT6 expression levels determined at step b) are higher than their reference values, or f) providing an intermediate prognosis when at least one expression level among two or more expression levels is indicative of a good prognosis and at least one expression level among two or more expression levels is indicative of a poor prognosis.

In exemplary embodiments, step b) consists of measuring the expression level of GCOM1, MEX3D, and TRPM4 in said sample.

In additional exemplary embodiments, step b) consists of measuring the expression level of OBSCN, FAM83H, CLDN7 and ARFGAP3 in said sample.

In some embodiments, the sample is a tumor sample.

Aspects of the invention also provide kits comprising the means for measuring the expression level of at least one biomarker as described herein.

Other aspects of the invention provide a method for treatment of prostate cancer, wherein a good, bad, or intermediate prognosis is provided using the methods described herein. The treatment methods further comprise beginning or continuing a treatment protocol comprising androgen deprivation therapy if a good or intermediate prognosis is provided, or beginning or continuing a treatment protocol comprising administering to said subject a therapeutically effective amount of an agent that alters the expression or activity of at least one gene that was measured in the prognostic method, if a poor prognosis is provided.

BRIEF DESCRIPTION OF THE DRAWINGS

FIG. 1A-D. LV-mediated mutagenesis screen. A) Schematic of LV-SFFVEGFP vector. The strong spleen focus-forming viral (SFFV) promoter drives the expression of enhanced green fluorescent protein (EGFP). The vector includes a R6Kγ origin of replication (R6Kori) and kanamycin resistance gene (KanR) for rescue in E. coli. Both long terminal repeats are self-inactivating (SIN.LTR). B) Experimental outline for in vitro LV-mediated insertional mutagenesis screen. Mutagenized sample (SVM-A) became androgen-independent before control, non-mutagenized cells. At this time genomic DNA was extracted and analyzed by the shuttle vector rescue approach. C) Shuttle vector rescue. Genomic DNA is sheared into smaller fragments. The ends are polished and the fragments are ligated into plasmids. Plasmids are transformed into electrocompetent E. coli. Using an LTR-specific primer, the junction between the provirus LTR and the chromosome DNA is sequenced. D) To identify the proviral integration site, the chromosomal DNA at the junction is used as a query and aligned to the human genome to identify the integration site.

FIG. 6A-C. Shuttle vector mutagenesis models a major mechanism whereby DSB-induced rearrangements dysregulate genes. In panel A two loci are shown where a strong promoter expresses gene X and a weaker regulated promoter expresses gene Y. In panel B a DSB-induced rearrangement places gene Y under the control of the gene X promoter, dysregulating gene Y and thereby promoting PC progression. In panel C an integrated shuttle vector provirus enhances expression of gene Y promoting PC progression.

DETAILED DESCRIPTION

Figure 2A:
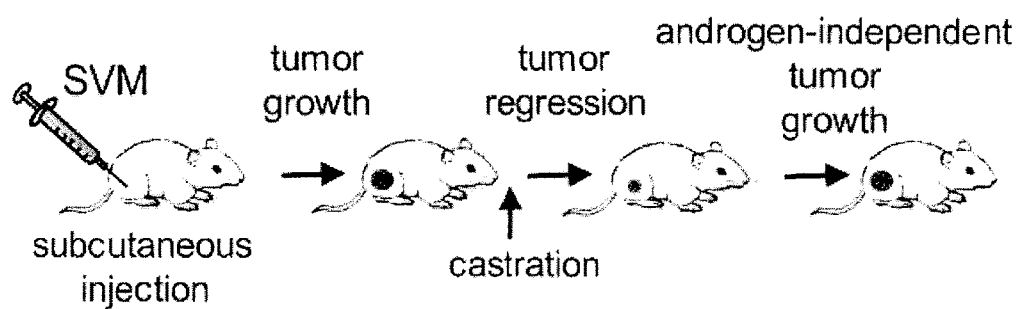
FIG. 2A-B. In vivo LV-mediated insertional mutagenesis screen. A) In vivo approach. Mice were injected with shuttle-vector mutagenized LNCaPs subcutaneously in the right flank. Following tumor development, mice were castrated and the tumors regressed in most mice. When the tumor re-grew to larger than pre-castration size, the tumor was removed, genomic DNA was extracted, and shuttle vector rescue was performed. B) Tumor growth in vivo. Animals were castrated between days 40-50 as indicated by the arrow.

Prostate cancer can be very heterogeneous in terms of clinical presentation and genomic profiling. The high heterogeneity is caused by abnormalities in many different cellular pathways which lead to tumor development. In addition, the genomic instability of the tumor cells causes the accumulation of genomic aberrations which do not contribute to tumor progression. Therefore, it is important to distinguish between 'driver' mutations which are functionally important and 'passenger' genes which do not provide a selective advantage to the tumor cells. Described herein are insertional mutagenesis screens to identify prostate cancer 'driver' genes. Sixteen prostate cancer driver genes were identified which serve as a gene signature to predict clinical outcome of patients with prostate cancer. Thus, described herein is the identification of unique gene signatures which are able to predict survival and patient outcome in prostate cancer. In addition, the sixteen genes are drug targets for the treatment of prostate cancer.

The terms "subject" and "patient" are used interchangeably herein, and refer to an animal such as a mammal, which is afflicted with or suspected of having, at risk of, or being pre-disposed to prostate cancer. In general, the terms refer to a human. The terms also include domestic animals bred for food, sport, or as pets, including horses, cows, sheep, poultry, fish, pigs, cats, dogs, and zoo animals, goats, apes (e.g. gorilla or chimpanzee), and rodents such as rats and mice. Typical subjects include persons susceptible to, suffering from or that have suffered prostate cancer. In aspects of the invention the subject or patient has had, or is about to have surgery, in particular a prostatectomy.

The term "diagnosed," as used herein, refers to the recognition of a disease by its signs and symptoms, or genetic analysis, pathological analysis, histological analysis, and the like.

"Prognosis" refers to a prediction of the course of a disease, such as prostate cancer. The prediction can include determining the likelihood of a subject to develop aggressive, recurrent disease, to survive a particular amount of time (e.g. determine the likelihood that a subject will survive 1, 2, 3, 4, or 5 years), to respond to a particular therapy (e.g., chemotherapy), or combinations thereof.

As used herein, the term "stage of cancer" refers to a qualitative or quantitative assessment of the level of advancement of a cancer. Criteria used to determine the stage of a cancer include, but are not limited to, the size of the tumor and the extent of metastases (e.g., localized or distant).

"Prostate cancer" refers to all stages and all forms of cancer arising from the tissue of the prostate gland. Classification systems such as the Gleason score may be used to classify primary prostate tumors. A tumor with a low Gleason score typically grows slowly and may not pose a significant threat to the patients in their lifetimes so the patients are monitored over time. Tumors with a higher Gleason score (greater than 5) are typically more aggressive patients are generally treated with surgery (e.g., radical prostatectomy) and, in some cases, therapy (e.g., radiation, hormone, ultrasound, chemotherapy). Staging systems such as the Jewitt-Whitmore system or the TNM (tumor, node, metastases) system may be used to stage overall disease. The Jewitt-Whitmore system classifies prostate cancer into one of four stages (i.e., A, B, C, and D) and includes subdivisions that reflect specific conditions within each category. The TNM system has stages similar to those of the Jewett-Whitmore system but it includes alphanumeric subcategories to describe primary tumors (T), regional lymph node involvement (N) or distant metastasis (M). "High risk prostate cancer" or "high risk disease" includes biochemical failure within 36 months of surgery (e.g., radical prostatectomy), aggressive disease (e.g. Gleason score greater than 4 or 5), higher incidence of recurrence or relapse of prostate cancer.

Any biological sample suspected of containing the cancer markers described herein may be tested according to methods of embodiments of the present invention. By way of non-limiting examples, the sample may be tissue (e.g., a prostate biopsy sample or a tissue sample obtained by prostatectomy), blood, urine, semen, prostatic secretions or a fraction thereof (e.g., plasma, serum, urine supernatant, urine cell pellet or prostate cells). A urine sample is preferably collected immediately following an attentive digital rectal examination (DRE), which causes prostate cells from the prostate gland to shed into the urinary tract.

The term "tumor sample" means any tissue tumor sample derived from the patient. Said tissue sample is obtained for the purpose of the in vitro evaluation. The sample can be fresh, frozen, fixed (e.g., formalin fixed), or embedded (e.g., paraffin embedded). In a particular embodiment the tumor sample may result from the tumor resected from the patient. In another embodiment, the tumor sample may result from a biopsy performed in the primary tumor of the patient or performed in a metastatic sample distant from the primary tumor of the patient. For example an endoscopical biopsy performed in the bowel of the patient affected by a colorectal cancer.

The term "gene" refers to a nucleic acid (e.g., DNA) sequence that comprises coding sequences necessary for the production of a polypeptide, precursor, or RNA (e.g., rRNA, tRNA). The polypeptide can be encoded by a full length coding sequence or by any portion of the coding sequence so long as the desired activity or functional properties (e.g., enzymatic activity, ligand binding, signal transduction, immunogenicity, etc.) of the full-length or fragments are retained. The term also encompasses the coding region of a structural gene and the sequences located adjacent to the coding region on both the 5' and 3' ends for a distance of about 1 kb or more on either end such that the gene corresponds to the length of the full-length mRNA. Sequences located 5' of the coding region and present on the mRNA are referred to as 5' non-translated sequences. Sequences located 3' or downstream of the coding region and present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene that are transcribed into nuclear RNA (hnRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

All the genes pertaining to the invention are known per se, and are listed in Table 1.

TABLE 1

List of genes according to the invention

| Gene | Name | Gene ID | SEQ ID NO: |
|---|---|---|---|
| GCOM1 | GRINL1A complex locus 1 | 145781 | 1 |
| MEX3D | mex-3 RNA binding family member D | 399664 | 2 |
| TRPM4 | transient receptor potential cation channel, subfamily M, member 4 | 54795 | 3 |
| ATPAF1 | ATP synthase mitochondrial F1 complex assembly factor 1 | 64756 | 4 |
| PTRF | polymerase I and transcript release factor | 284119 | 5 |
| OBSCN | Obscurin, cytoskeletal calmodulin and titin-interacting RhoGEF | 84033 | 6 |
| FLNA | Filamin A | 2316 | 7 |
| CLDN7 | Claudin 7 | 1366 | 8 |
| FAM83H | Family with sequence similarity 83, Member H | 286077 | 9 |
| KDM2A | Lysine-specific Histone demethylase 2A | 22992 | 10 |
| WHSC1 | Wolf-Hirschhorn syndrome candidate 1 | 7468 | 11 |
| B3GNT9 | UDP-GlcNAc: BetaGal Beta-1,3-N-Acetylglucosaminyltransferase9 | 84752 | 12 |
| GLYATL1 | Glycine N-acyltransferase like-1 | 92292 | 13 |
| ARFGAP3 | ADP-Ribosylation Factor GTPase-Activating protein 3 | 26286 | 14 |
| STRA13 | Stimulated by Retinoic Acid 13 | 201254 | 15 |
| CNOT6 | CCR4-NOT Transcription complex, subunit 6 | 57472 | 16 |

The term "gene cluster" refers to a set of at least one gene selected from the group consisting of the genes of Table 1. Accordingly, said gene cluster may comprise 1, 2, 3, 4, 5, 6, 7, 8, 9, 10, 11, 12, 13, 14, 15, or 16 gene(s) of Table 1.

As used herein, the term "hybridization" is used in reference to the pairing of complementary nucleic acids. Hybridization and the strength of hybridization (i.e. the strength of the association between the nucleic acids) is impacted by such factors as the degree of complementary between the nucleic acids, stringency of the conditions involved, the $T_m$ of the formed hybrid, and the G:C ratio within the nucleic acids. A single molecule that contains pairing of complementary nucleic acids within its structure is said to be "self-hybridized."

An array refers to an arrangement of molecules, such as biological macromolecules (such as peptides or nucleic acid molecules) or biological samples (such as tissue sections), in addressable locations on or in a substrate. A "microarray" is an array that is miniaturized so as to require or be aided by microscopic examination for evaluation or analysis. Arrays are sometimes called DNA chips or biochips. In particular examples, an array consists essentially of polynucleotide or polypeptide probes. Exemplary probes include, but are not limited to, primers or antibodies (such as those that permit amplification or detection) specific for ATPAF1, GCOM1, MEX3D, PTRF, TRPM4, GLYATL1, FLNA, OBSCN, STRA13, WHSC1, ARFGAP3, KDM2A, FAM83H, CLDN7, CNOT6 and/or B3GNT9, and in some examples, also 1 to 10 control molecules (such as housekeeping genes).

Microarrays are prepared by selecting probes and immobilizing them to a solid support or surface which may be either porous or non-porous. For example, the probes can be attached to a nitrocellulose or nylon membrane or filter covalently at either the 3' or the 5' end of the polynucleotide probe. In some embodiments, the microarray is an antibody microarray where probes consist of antibodies that bind to protein molecules produced from the genes described herein are spotted and fixed on a solid support or surface. The solid support may be a glass or plastic surface. In an aspect of the invention, hybridization levels are measured to microarrays of probes consisting of a solid support on the surface of which are immobilized a population of polynucleotide probes. The population of probes can include 1, 2, 3, 4, 5, 6, 7, 8, 9, 10, 11, 12, 13, 14, 15, or 16 probes that are complementary to any of SEQ ID NOs 1-16. In another aspect of the invention, binding levels are measured to microarrays of antibodies consisting of a solid support on the surface of which are immobilized a population of antibodies. The population of antibodies can include 1, 2, 3, 4, 5, 6, 7, 8, 9, 10, 11, 12, 13, 14, 15, or 16 antibodies that recognize the proteins encoded by any of SEQ ID NOs 1-16.

"Clinical outcome" refers to the health status of a patient following treatment for a disease or disorder, or in the absence of treatment. Clinical outcomes include, but are not limited to, an increase in the length of time until death, a decrease in the length of time until death, an increase in the chance of survival, an increase in the risk of death, survival, disease-free survival, chronic disease, metastasis, advanced or aggressive disease, disease recurrence, death, and favorable or poor response to therapy.

The term "treating" or "treatment", as used herein, means reversing, alleviating, inhibiting the progress of, or preventing the disorder or condition to which such term applies, or one or more symptoms of such disorder or condition.

A "therapeutically effective amount" refers to a minimal amount of therapeutic agent which is necessary to impart therapeutic benefit to a subject. For example, a "therapeutically effective amount" to a mammal is such an amount which induces, ameliorates or otherwise causes an improvement in the pathological symptoms, disease progression or physiological conditions associated with or resistance to succumbing to a disorder.

"Therapeutic agent" refers to a chemical compound, small molecule, or other composition, such as an antisense compound, antibody, protease inhibitor, hormone, chemokine or cytokine, capable of inducing a desired therapeutic or prophylactic effect when properly administered to a subject. For example, therapeutic agents for prostate cancer include agents that prevent or inhibit development or metastasis of prostate cancer.

METHODS OF THE INVENTION

Embodiments of the invention provide a method for the prognosis of prostate cancer progression in a subject, said method comprising:
a) obtaining a biological sample from said subject,
b) measuring in said sample the gene expression level of at least one gene selected from the group consisting of GCOM1, MEX3D, TRPM4, ATPAF1, PTRF, GLYATL1, FLNA, OBSCN, STRA13, WHSC1, ARFGAP3, KDM2A, FAM83H, CLDN7, CNOT6 and B3GNT9
c) comparing every expression level determined at step b) with a reference value, and
d) providing a good prognosis when GCOM1, PTRF, OBSCN, FLNA, B3GNT6, and/or KDM2A expression levels determined at step b) are higher than their reference values and/or MEX3D, TRPM4, ATPAF1, GLYATL1, STRA13, WHSC1, ARFGAP3, FAM83H, CLDN7, and/or CNOT6 expression levels determined at step b) are lower than their reference values, or
e) providing a poor prognosis when GCOM1, PTRF, OBSCN, FLNA, B3GNT6, and/or KDM2A expression levels determined at step b) are lower than their reference values and/or MEX3D, TRPM4, ATPAF1, GLYATL1, STRA13, WHSC1, ARFGAP3, FAM83H, CLDN7, and/or CNOT6 expression levels determined at step b) are higher than their reference values, or
f) providing an intermediate prognosis when at least one expression level among two or more expression levels is indicative of a good prognosis and at least one expression level among two or more expression levels is indicative of a poor prognosis.

In exemplary embodiments, step b) consists of measuring the expression level of GCOM1, MEX3D, and TRPM4 in said sample.

In additional exemplary embodiments, step b) consists of measuring the expression level of OBSCN, FAM83H, CLDN7 and ARFGAP3 in said sample.

In some embodiments, one or a plurality of genes that are overexpressed in prostate cancer are measured. For example, step b) consists of measuring the expression level of at least one or more of ATPAF1, MEX3D, TRPM4, GLYATL1, STRA13, WHSC1, ARFGAP3, FAM83H, CLDN7, and CNOT6 in said sample. Accordingly, said gene cluster may comprise 1, 2, 3, 4, 5, 6, 7, 8, 9, or 10 genes listed in this paragraph.

In still other embodiments, one or a plurality of genes that are underexpressed in prostate cancer are measured. For example, step b) consists of measuring the expression level of at least one or more of GCOM1, PTRF, OBSCN, FLNA, B3GNT6, and KDM2A in said sample. Accordingly, said gene cluster may comprise 1, 2, 3, 4, 5, or 6 genes listed in this paragraph.

In some embodiments, the sample is a tumor sample.
In some embodiments, the methods of the invention further comprise the step of concluding the subject has androgen-independent prostate cancer if a poor prognosis is provided. In some aspects, the good prognosis is at least one of a decrease in recurrence risk, an increase in the likelihood of survival, an increase in the time of survival, or a decrease in the risk of metastasis. In other aspects, the poor prognosis is at least one of an increase in recurrence risk, a decrease in the likelihood of survival, a decrease in the time of survival, or an increase in the risk of metastasis. In exemplary embodiments, the reference value is determined in regard to a gene expression level measured in samples taken from one or more healthy subjects. In some embodiments, the subject has had a prostatectomy.

Additional aspects of the invention provide a diagnostic method comprising identifying a patient who is a candidate for treatment for prostate cancer and determining the expression level of a gene cluster according to the invention in a sample obtained from the patient, wherein an abnormal status of at least one gene in the sample indicates that treatment is desirable or necessary. Intermediate conclusions are provided when at least one gene is indicative of a good prognosis while at least one other gene is indicative of a poor prognosis. When the expression level of a gene is indicative of a good prognosis, it is indicative of a positive response of the patient to the treatment.

In some embodiments, the invention provides a method for the treatment of prostate cancer in a subject, said method comprising:
a) obtaining a tumor sample from said subject,
b) measuring in said sample the gene expression level of at least one gene selected from the group consisting of GCOM1, MEX3D, TRPM4, ATPAF1, PTRF, GLYATL1, FLNA, OBSCN, STRA13, WHSC1, ARFGAP3, KDM2A, FAM83H, CLDN7, CNOT6 and B3GNT9
c) comparing every expression level determined at step b) with a reference value, and
d) providing a good prognosis when GCOM1, PTRF, OBSCN, FLNA, B3GNT6, and/or KDM2A expression levels determined at step b) are higher than their reference values and/or MEX3D, TRPM4, ATPAF1, GLYATL1, STRA13, WHSC1, ARFGAP3, FAM83H, CLDN7, and/or CNOT6 expression levels determined at step b) are lower than their reference values, or
e) providing a poor prognosis when GCOM1, PTRF, OBSCN, FLNA, B3GNT6, and/or KDM2A expression levels determined at step b) are lower than their reference values and/or MEX3D, TRPM4, ATPAF1, GLYATL1, STRA13, WHSC1, ARFGAP3, FAM83H, CLDN7, and/or CNOT6 expression levels determined at step b) are higher than their reference values, or
f) providing an intermediate prognosis when at least one expression level among two or more expression levels is indicative of a good prognosis and at least one expression level among two or more expression levels is indicative of a poor prognosis, and
g) beginning or continuing a treatment protocol comprising androgen deprivation therapy if a good or intermediate prognosis is provided, or
h) beginning or continuing a treatment protocol comprising administering to said subject a therapeutically effective amount of an agent that alters the expression or activity of at least one gene that was measured in step b), if a poor prognosis is provided.

In exemplary embodiments, step b) consists of measuring the expression level of GCOM1, MEX3D, and TRPM4 in said sample.

In additional exemplary embodiments, step b) consists of measuring the expression level of OBSCN, FAM83H, CLDN7 and ARFGAP3 in said sample.

In some embodiments, the measuring step is performed using an array analysis or an immunoassay. The array analysis can include detection of a DNA-probe complex or an RNA-probe complex immobilized onto a solid support.

The immunoassay can include detection of a protein-probe complex immobilized onto a solid support.

In some embodiments, step b) includes ten or more cycles of PCR amplification of the at least one gene.

In some aspects, the good prognosis is at least one of a decrease in recurrence risk, an increase in the likelihood of survival, an increase in the time of survival, or a decrease in the risk of metastasis. In other aspects, the poor prognosis is at least one of an increase in recurrence risk, a decrease in the likelihood of survival, a decrease in the time of survival, or an increase in the risk of metastasis. In exemplary embodiments, the reference value is determined in regard to a gene expression level measured in samples taken from one or more healthy subjects.

It is specifically contemplated that the invention can be used to evaluate differences between stages of the cancer, such as between hyperplasia, neoplasia, pre-cancer and cancer, or between a primary tumor and a metastasized tumor. In a particular embodiment, the cancer is at Stage I, II, III, or IV as determined by the TNM classification.

Therefore the methods of the invention further comprise a step of comparing the expression level of one gene cluster (as described herein) determined in the sample of the patient with a reference expression level of said gene cluster, wherein a difference between said expression levels is indicative of the stage of the cancer in the patient.

The reference expression levels according to the invention are correlated with a specific cancer stage. The reference expression levels may include the expression level of said gene cluster in a tissue reference such a tissue representative of a non-cancerous stage or a tissue representative of a tissue representative of cancer stage. Accordingly, the reference levels may be predetermined by carrying out a method comprising the steps of a) providing at least one collection of tumor tissue samples selected from the group consisting of a collection of tumor tissue samples from cancer patients having different stages such as between hyperplasia, neoplasia, pre-cancer and cancer, or between a primary tumor and a metastasized tumor, b) determining for each tumor tissue sample comprised in a collection of tumor tissue samples provided at step a), the expression level of said gene clusters.

Methods of the invention can be applied for monitoring the treatment (e.g., drug compounds) of a patient suffering from cancer. For example, the effectiveness of an agent to affect the expression level of the gene cluster according to the invention can be monitored during treatments of patients receiving anti-cancer treatments.

The "anti-cancer treatment" refers to any type of cancer therapy undergone by the cancer patients previously to collecting the tumor tissue samples, including radiotherapy, chemotherapy and surgery, e.g. surgical resection of the tumor.

In some embodiments, the method for monitoring the treatment of a patient affected with a cancer comprises the steps of:
i) determining the stage or severity of said cancer before said treatment by performing the method of the invention,
ii) determining the stage or severity of said cancer after said treatment by performing the method of the invention, and
iii) comparing the stage or severity determined a step i) with the stage or severity determined at step ii) wherein a difference between said stages is indicative of the effectiveness of the treatment.
iv) comparing the prognosis provided before beginning or continuing the treatment protocol to the second prognosis wherein a difference between the prognoses is indicative of the effectiveness of the treatment.

In some embodiments, comparisons are performed using prostate specific antigen (PSA) where a PSA level that rises to 50% of a pretreatment value or an absolute value greater than 5-10 ng/ml indicates a reduction in the effectiveness of treatment. A treatment protocol could consist of (but is not limited to) anti-androgen drugs including the luteinizing hormone-releasing hormone analog Degarelix, or androgen receptor antagonist such as Bicalutamide or MDV3100. In some embodiments, if the gene expression level of at least one of ATPAF1, MEX3D, TRPM4, GLYATL1, STRA13, WHSC1, ARFGAP3, FAM83H, CLDN7, and CNOT6 decreases and/or the gene expression level of at least one of GCOM1, PTRF, OBSCN, FLNA, B3GNT6, and KDM2A increases by about 5% or more than the treatment is effective. Alternatively, if the gene expression levels measured between steps i) and ii) are unchanged or the gene expression level of at least one of ATPAF1, MEX3D, TRPM4, GLYATL1, STRA13, WHSC1, ARFGAP3, FAM83H, CLDN7, and CNOT6 increases and/or the gene expression level of at least one of GCOM1, PTRF, OBSCN, FLNA, B3GNT6, and KDM2A decreases by about 5% or more, then the treatment is not effective.

In some embodiments, the methods of the invention are used for predicting the outcome of a cancer in a patient, wherein said method may be used independently from conventional clinicopathological cancer staging methods, and which method comprises determining the expression level of a gene cluster according to the invention.

In some embodiments, the methods of the invention are used for determining if a patient will respond to treatment. After determining the expression level of a gene cluster according to the invention, the method further comprises a step of concluding that a patient will significantly respond to the treatment if a good or intermediate prognosis is provided.

The results of a subject's diagnosis, screening, prognosis or monitoring is typically displayed or provided to a user such as a clinician, health care worker or other caregiver, laboratory personnel or the patient. The results may be quantitative information (e.g. the level or amount of gene expression compared to a control) or qualitative information (e.g. poor prognosis). The output can include tools for interpreting the results to arrive at a diagnosis, prognosis or treatment plan, for example, an output may include ranges or cutoffs for abnormal or normal status to arrive at a diagnosis, prognosis, or treatment plan. The output can also provide a recommended therapeutic plan, and it may include other clinical information and guidelines and instructions for interpreting the information.

In some embodiments, the invention provides a method for assessing the efficacy of a test compound for modulating high risk prostate cancer in a patient, the method comprising comparing:
(a) levels of at least one gene cluster as described herein, and optionally other biomarkers for prostate cancer, in a first sample obtained from a patient and exposed to the test compound; and
(b) levels of least one gene cluster as described herein, and optionally other biomarkers, in a second sample obtained from the patient, wherein the sample is not exposed to the test compound, wherein a significant difference in the levels of expression of the gene cluster, and optionally other biomarkers, in the first sample, relative to the second sample, is an indication that the test agent is efficacious for modulating high risk prostate cancer in the patient. The first and second samples may be portions of a single sample obtained from a patient or portions of pooled samples obtained from a patient.

For example, the expression levels of a gene that is overexpressed in prostate cancer such as ATPAF1 is measured in a first sample obtained from a patient. After exposing a test compound "X" with a second sample obtained from the patient, the levels of ATPAF1 are measured again. If the level of ATPAF1 has decreased as compared to the first measurement, then compound "X" is concluded to be efficacious for treating prostate cancer. However, if the level of ATPAF1 has not changed or has increased, then compound "X" is not an effective drug.

Alternatively, the expression levels of a gene that is underexpressed in prostate cancer such as GCOM1 is measured in a first sample obtained from a patient. In this case, if the level of GCOM1 has increased in the second sample that was exposed to compound "X", as compared to the first measurement, then compound "X" is concluded to be efficacious for treating prostate cancer. However, if the level of GCOM1 has not changed or has decreased, then compound "X" is not an effective drug.

Methods of determining "significant" changes in gene expression levels, at both the mRNA and protein levels, are well known in the art. "Significant" generally refers to reproducibly raised or lowered levels as compared to a control which is typically represented as a p-value. The significance level, for example, can be set at 1% or 5%. Techniques for measuring the expression level of the gene clusters Measuring the expression level of the gene clusters of the invention in the sample obtained from the patient can be performed by a variety of techniques well known in the art. Typically, the expression level of a gene may be determined by determining the quantity of nucleic acid (mRNA or cDNA). Methods for determining the quantity of mRNA are well known in the art. For example the nucleic acid contained in the samples (e.g., cell or tissue prepared from the subject) is first extracted according to standard methods, for example using lytic enzymes or chemical solutions or extracted by nucleic-acid-binding resins following the manufacturer's instructions. The extracted mRNA is then detected by hybridization (e.g., Northern blot analysis) and/or amplification (e.g., RT-PCR). Preferably quantitative or semi-quantitative RT-PCR is preferred. In exemplary embodiments, the amplification step involves ten or more cycles of PCR. Real-time quantitative or semi-quantitative RT-PCR is particularly advantageous. Other methods of Amplification include ligase chain reaction (LCR), transcription mediated amplification (TMA), strand displacement amplification (SDA) and nucleic acid sequence based amplification (NASBA).

Nucleic acids having at least 10 nucleotides and exhibiting sequence complementarity or homology to the mRNA of interest herein find utility as hybridization probes or amplification primers. It is understood that such nucleic acids need not be identical, but are typically at least about 80% identical to the homologous region of comparable size, more preferably 85% identical and even more preferably 90-95% identical. In certain embodiments, it will be advantageous to use nucleic acids in combination with appropriate means, such as a detectable label, for detecting hybridization. A wide variety of appropriate indicators are known in the art including, fluorescent, radioactive, enzymatic or other ligands (e.g. avidin/biotin).

Polynucleotide probes typically comprise single-stranded nucleic acids of between 10 to 1000 nucleotides in length, for instance of between 10 and 800, more preferably of between 15 and 700, typically of between 20 and 500. Primers typically are shorter single-stranded nucleic acids, of between 10 to 25 nucleotides in length, designed to perfectly or almost perfectly match a nucleic acid of interest, to be amplified. The probes and primers are "specific" to the nucleic acids they hybridize to, i.e. they preferably hybridize under high stringency hybridization conditions (corresponding to the highest melting temperature Tm, e.g., 50% formamide, 5× or 6×SCC. SCC is a 0.15 M NaCl, 0.015 M Na-citrate).

The nucleic acid primers or probes used in the above amplification and detection methods may be assembled as a kit. Such a kit includes consensus primers and molecular probes. A preferred kit also includes the components necessary to determine if amplification has occurred. The kit may also include, for example, PCR buffers and enzymes; positive control sequences, reaction control primers; and instructions for amplifying and detecting the specific sequences.

In a particular embodiment, the methods of the invention comprise the steps of providing total RNAs extracted from cumulus cells and subjecting the RNAs to amplification and hybridization to specific probes, more particularly by means of a quantitative or semi quantitative RT-PCR.

In another embodiment, the expression level is determined by DNA chip analysis. Such DNA chip or nucleic acid microarray consists of different nucleic acid probes that are chemically attached to a substrate or solid support, which can be a microchip, a glass slide or a microsphere-sized bead. A microchip may be constituted of polymers, plastics, resins, polysaccharides, silica or silica-based materials, carbon, metals, inorganic glasses, or nitrocellulose. Probes comprise nucleic acids such as cDNAs or oligonucleotides that may be about 10 to about 60 base pairs. To determine the expression level, a sample from a test subject, optionally first subjected to a reverse transcription, is labelled and contacted with the microarray in hybridization conditions, leading to the formation of complexes between target nucleic acids that are complementary to probe sequences attached to the microarray surface. The labelled hybridized complexes are then detected and can be quantified or semi-quantified.

In some embodiments, gene expression is measured at the protein level. Examples of methods to measure the amount/level of a protein in a sample include, but are not limited to: Western blot, immunoblot, enzyme-linked immunosorbent assay (ELISA), "sandwich" immunoassays, radioimmunoassay (RIA), immunoprecipitation, surface plasmon resonance (SPR), chemiluminescence, fluorescent polarization, phosphorescence, immunohistochemical (IHC) analysis, matrix-assisted laser desorption/ionization time-of-flight (MALDI-TOF) mass spectrometry, microcytometry, microarray, antibody array, microscopy (e.g., electron microscopy), flow cytometry, and proteomic-based assays.

Labelling may be achieved by various methods, e.g. by using radioactive or fluorescent labelling. Many variants of the microarray hybridization technology are available to the man skilled in the art (see e.g. the review by Hoheisel, Nature Reviews, Genetics, 2006, 7:200-210).

Expression level of a gene may be expressed as absolute expression level or normalized expression level. Typically, expression levels are normalized by correcting the absolute expression level of a gene by comparing its expression to the expression of a gene that is not relevant for determining the cancer stage of the patient, e.g., a housekeeping gene that is constitutively expressed. Suitable genes for normalization include housekeeping genes such as the actin gene ACTB, ribosomal 18S gene, GUSB, PGK1 and TFRC. This normalization allows the comparison of the expression level in one sample, e.g., a patient sample, to another sample, or between samples from different sources.

Kits

A further aspect of the invention relates to kits for performing the methods of the invention, wherein said kits comprise means for measuring the expression level of the gene clusters of the invention in the sample obtained from the patient. In exemplary embodiments, the kit for the prognosis of prostate cancer progression comprises at least one probe that hybridizes with a nucleotide sequence of at least one gene selected from the group consisting of GCOM1, MEX3D, TRPM4, ATPAF1, PTRF, GLYATL1, FLNA, OBSCN, STRA13, WHSC1, ARFGAP3, KDM2A, FAM83H, CLDN7, CNOT6 and B3GNT9. In some embodiments, the kit comprises probes that hybridize with a plurality of nucleotide sequences selected from the group consisting of SEQ ID NO: 1-16.

The kits may include probes, primers, macroarrays, or microarrays as described herein. Kits may typically comprise two or more components required for performing a diagnostic, prognostic, or screening assay. Components include but are not limited to compounds, reagents, containers, and/or equipment. The components may be packaged with the necessary materials into suitable containers. Controls (such as positive and negative controls) can also be included in some kits.

For example, the kit may comprise a set of probes as above defined, usually made of DNA, and that may be pre-labelled. Alternatively, probes may be unlabelled and the ingredients for labelling may be included in the kit in separate containers. The kit may further comprise hybridization reagents or other suitably packaged reagents and materials needed for the particular hybridization protocol, including solid-phase matrices, if applicable, and standards.

Alternatively, the kit of the invention may comprise amplification primers that may be pre-labelled or may contain an affinity purification or attachment moiety. The kit may further comprise amplification reagents and also other suitably packaged reagents and materials needed for the particular amplification protocol.

In a particular embodiment, the kit of the invention comprises means for determining the expression level of a gene cluster in a sample obtained from said patient, wherein said gene cluster comprises at least one of GCOM1, MEX3D, TRPM4, ATPAF1, PTRF, GLYATL1, FLNA, OBSCN, STRA13, WHSC1, ARFGAP3, KDM2A, FAM83H, CLDN7, CNOT6 and B3GNT9In some embodiments, a kit also includes instructions for using the kit components as well as the use of any other reagent not included in the kit. Instructions may include variations that can be implemented. A kit may also include utensils or devices for performing a method described herein.

Before exemplary embodiments of the present invention are described in greater detail, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges and are also encompassed within the invention, subject to any specifically excluded limit in the stated range. Where the stated range includes one or both of the limits, ranges excluding either or both of those included limits are also included in the invention.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present invention is not entitled to antedate such publication by virtue of prior invention. Further, the dates of publication provided may be different from the actual publication dates which may need to be independently confirmed.

It is noted that, as used herein and in the appended claims, the singular forms "a", "an", and "the" include plural referents unless the context clearly dictates otherwise. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

The invention is further described by the following non-limiting examples which further illustrate the invention, and are not intended, nor should they be interpreted to, limit the scope of the invention.

Example 1. Identification of Driver Genes Involved in Androgen-Independent Prostate Cancer that Predict Recurrence Free Survival of Prostate Cancer Patients

SUMMARY

Insertional mutagenesis screens have been used with great success to identify oncogenes and tumor suppressor genes. Typically, these screens use gammaretroviruses (γRV) or transposons as insertional mutagens. However, insertional mutations from replication-competent γRVs or transposons that occur later during oncogenesis can produce passenger mutations that do not drive cancer progression. Here, a replication-incompetent lentiviral vector (LV) was utilized to perform an insertional mutagenesis screen to identify genes in the progression to androgen-independent prostate cancer (AIPC).

Prostate cancer cells were mutagenized with a LV to enrich for clones with a selective advantage in an androgen-deficient environment provided by a dysregulated gene(s) near the vector integration site. The screen was performed using an in vitro AIPC model and also an in vivo xenotransplant model for AIPC. The approach identified proviral integration sites utilizing a shuttle vector that allows for rapid rescue of plasmids in E. coli that contain LV long terminal repeat (LTR)-chromosome junctions. This shuttle vector approach does not require PCR amplification and has several advantages over PCR-based techniques.

Proviral integrations were enriched near prostate cancer susceptibility loci in cells grown in androgen-deficient medium (p<0.001), and five genes that influence AIPC were identified; ATPAF1, GCOM1, MEX3D, PTRF, and TRPM4. Additionally, it was shown that RNAi knockdown of ATPAF1 significantly reduces growth (p<0.05) in androgen-deficient conditions. This approach has proven effective for use in PC, identifying a known prostate cancer gene, PTRF, and also several genes not previously associated with prostate cancer.

It was further demonstrated that each of the identified genes, alone and in combination, can predict recurrence free survival of PC patients after prostatectomy.

Introduction

One way to greatly expand the potential of forward mutagenesis screens is to use replication-incompetent lentiviral vectors (LVs) [4]. Human immunodeficiency virus (HIV)-derived LVs that are pseudotyped with the vesicular stomatitis virus glycoprotein can efficiently transduce essentially all mammalian cell types. Replication-incompetent LVs integrate into the genome but do not replicate, and thus do not create additional insertion sites. Therefore, there are fewer potential passenger integrations than with replication-competent vectors, where driver insertional mutation events may be masked by the accumulation of bystander integrations [4,5]. Also the level of mutagenesis can be carefully controlled by adjusting the multiplicity of infection. Importantly, under the right conditions replication-competent vectors can cause cancer, which was unfortunately observed in gene therapy studies where replication-incompetent γRV vectors caused leukemia [6,7].

Herein a novel screen is reported to identify genes in the progression to androgen-independent prostate cancer (AIPC) in human cells using a replication-incompetent HIV-based LV. The current study was designed to identify genes involved in the progression to AIPC. The human LNCaP PC cell line model for AIPC is well-established [11,14,15]. LNCaP cells express androgen receptor, prostate-specific antigen, and generate androgen-independence by distinct mechanisms [11,15]. Additionally, LNCaP cells readily form tumors in immunodeficient mice allowing in vivo studies [16,17]. A transposon-based mutagenesis screen has been performed for PC that specifically investigated PC precursor lesions and genes that were involved in PC initiation [18].

A major advantage of the approach described herein is the use of a LV shuttle vector that allows rescue of vector LTR-chromosome junctions in bacteria as plasmids. In other retroviral and transposon-based screens, PCR is typically used to recover these proviral insertions and in turn detect dysregulated genes [1,19]. However, PCR lacks the sensitivity to detect integrations events that are rare or poorly amplified. It has previously been suggested that plasmid-based rescue of the provirus integration might eventually replace PCR methods [1]. This study demonstrates the effectiveness of this approach in a mutagenesis screen for AIPC.

Materials and Methods

Cell Line Culture, Vector Production and Transduction

The androgen-dependent human prostate carcinoma cell line LNCaP-FGC (ATCC CRL-1740) was cultured in RPMI-1640 supplemented with 10% FBS (Atlanta Biologicals, Lawrenceville, Ga.) at 37° C. in 5% $CO_2$. The LV shuttle vector, LV-SFFVEGFP, has self-inactivating long terminal repeats (LTRs), an internal spleen focus-forming virus promoter driving EGFP expression, and R6Kγ origin of replication and a neomycin phosphotransferase gene. Vesicular stomatitis virus glycoprotein pseudotyped vector stocks were made by PEI-mediated transfection of HEK-293T cells as previously described [64]. Functional titers were determined by transduction of HT-1080 fibrosarcoma cells. Cells were cultured for 14 days post vector exposure prior to use in experiments.

Shuttle Vector Rescue in Bacteria, Identification of Integration Sites and Clonality Evaluation Genomic DNA was isolated using the Puregene® Cell & Tissue kit (Qiagen Inc., Valencia, Calif.) and was sheared using a Hydroshear® (DigiLab Inc., Marlborough, Mass.). The ends of the DNA were repaired using the DNA Teiminator® End Repair Kit (Lucigen Corporation, Middleton, Wis.). Sheared fragments were ligated using T4 DNA Ligase (New England Biolabs, Inc., Ipswich, Mass.) and transformed by electroporation. Shuttle vector plasmids from kanamycin-resistant colonies were sequenced using primers specific to the LV LTR. A total of 288 colonies were sequenced for the in vitro cultures and 96 colonies were sequenced for each tumor. The junction between the integrated provirus and the chromosome was identified and integration sites in the human genome (hg19) were determined using PERL bioinformatics programs [21] that invoke a standalone BLAT program [65]. To be considered as an integration site the alignment score had to have a canonical LTR-chromosome junction and meet additional strict criteria as previously described [21]. A control dataset of 10,000 random sites was generated as previously described [65]. The Schnabel method of multiple-census mark-recapture was used to approximate the number of unique integration sites in the entire population prior to selection for androgen independence [66,67].

In Vitro Androgen-Independent Culture

Control and LV-SFFVEGFP transduced LNCaP cells were maintained in RPMI-1640 supplemented with 9.75% charcoal/dextran-treated FBS (CT-FBS) and 0.25% FBS (Atlanta Biologicals, Lawrenceville, Ga.), before being moved to and maintained in RPMI-1640 supplemented with 10% CT-FBS. Cells were counted using a Cellometer® Auto T4 (Nexcelom Bioscience Inc., Lawrence, Mass.) and replated approximately every 2-3 weeks.

In Vivo Model of PC

All protocols involving the use of animals were approved by the Washington State University Institutional Animal Care and Use Committee and institutional guidelines for the humane use of animals in research were followed. Male 4-8 week old NSG mice were obtained from The Jackson Laboratory (Bar Harbor, Me.). LV-mutagenized or control LNCaP cells were inoculated via subcutaneous injection. Between $1\text{-}5\times10^6$ cells were suspended in 100 μL of RPMI-1640 plus 5% FBS plus 100 μL Matrigel (BD Biosciences, Bedford, Mass.) and injected via a 25 gauge needle into the right flank. Tumors were visually monitored or measured once to twice weekly and their volumes were calculated using the formula L×W×H×0.5236 [17]. To select for androgen-independent tumor growth in vivo, mice were castrated via the scrotal approach. Mice were anesthetized with isoflurane or ketamine and xylazine (80 mg/kg and 6 mg/kg, respectively). When tumors reached volumes larger than the tumor size prior to castration, mice were sacrificed, tumor tissue was harvested. Genomic DNA was obtained from tumor tissue using the Puregene® Cell & Tissue kit (Qiagen Inc., Valencia, Calif.).

Validation of the Effect of Target Genes on AIPC Using LV-Mediated RNAi pGIPZ lentiviral shRNA vector sets of 3-6 shRNA vectors were obtained from Thermo Fisher Scientific (Waltham, Mass.) for the selected target genes. Gene knockdown was evaluated using the psiCHECK™-2 system (Promega Corporation, Madison, Wis.) using a synthesized sequence (GenScript USA, Inc., Piscataway, N.J.) containing target sites for each target gene shRNA cloned into the psiCHECK™-2 vector. psiCHECK™-2 vectors containing these target fragments were co-transfected with pGIPZ shRNA vector sets for each specific target gene. The efficiency of the knockdown for each shRNA for each gene was determined with the Dual-Luciferase® Reporter Assay System (Promega Corporation, Madison, Wis.). The shRNA which demonstrated the most efficient knockdown of luciferase activity for each target gene was selected. Vesicular stomatitis virus glycoprotein pseudotyped vector stocks were made by PEI-mediated transfection of HEK-293T cells as described above. LNCaP cells for in vitro validation were transduced at a multiplicity of infection of 5, selected in 2.5 μg/mL puromycin, and expanded. RT-PCR was used to quantitate the expression levels of these genes in the pGIPZ transduced LNCaP cells. Total RNA from LNCaP cells transduced with a LV carrying a shRNA sequence against the candidate genes or vector with no shRNA (EV) was isolated using TRIzol reagent (Invitrogen, Carlsbad, Calif.). cDNA was synthesized from the total RNA using Transcription First Strand Synthesis Kit (Roche Diagnostics, Indianapolis, Ind.). cDNA was used as a template to amplify gene specific products. Transduced puromycin-resistant LNCaP cells were cultured in androgen-deficient medium and cell number determined as described above.

Statistical Analysis

To assess the enrichment of proviruses in PC susceptibility loci after selection for androgen-independence, a $\chi^2$ test of the frequency of integration sites was used. To assess the effects of shRNA knockdown of PTRF and ATPAF1 on androgen-independence a Student's t-test was used.

Analysis of Identified Driver Genes

It was investigated whether the expression levels of the candidate genes identified in the screen correlated with clinical outcome of prostate cancer patients using SurvExpress [68]. Based on the differential expression of the gene(s) in PC patients, the tool stratifies the patient samples into low and high risk groups and derives Kaplan-Meier curves defining the survival risk of the patients. The dataset used was generated by Taylor et al. (2010)[34] which has a large number of patient tumor samples (140) collected from PC patients after treatment and was thus used to determine the prognostic value of the candidate genes, TRPM4, GCOM1, PTRF, ATPAF1, and MEX3D in predicting recurrence risk in cancer patients after prostatectomy.

Results

Efficient LV Transduction Results in a Library of Mutagenized PC Cells where Clonality can be Rapidly Assessed by Shuttle Vector Rescue To identify candidate genes involved in the progression to AIPC, a replication-incompetent LV, LV-SFFVEGFP (FIG. 1A) that has a strong spleen focus-forming virus promoter known to dysregulate genes was utilized [20], and also includes a bacterial origin of replication and a kanamycin resistance gene to allow identification of integration sites by rescue of shuttle vector plasmids in *E. coli*. This approach uses random shearing of genomic DNA to avoid restriction site bias [21] and does not require any PCR amplification so it also eliminates PCR-based bias. The LV expresses EGFP gene from the spleen focus-forming virus promoter, allowing for efficient tracking of transduced cells in vitro and in vivo (FIG. 1B). The androgen-dependent human PC cell line, LNCaP, was transduced in triplicate with LV-SFFVEGFP resulting in three independent cultures of LNCaP cells denoted shuttle vector-mutagenized (SVM)-A, -B, and -C. The transduction frequency was over 99% as assessed by EGFP expression.

The clonality of these cultures prior to selection for androgen independence was evaluated to ensure that cells used for the mutagenesis screen were polyclonal. It was reasoned that a highly polyclonal pool of integrations, in essence a library, would improve the ability of this screen to identify AIPC progression genes. High-throughput sequencing of shuttle vector rescued plasmids was performed to identify provirus-chromosome junctions (FIGS. 1C and 1D). Sequences were aligned to the human genome to identify the provirus integration site in the human genome. A clonality calculation was performed to approximate the number of unique integrations present in each sample prior to selection for androgen-independence. By counting both the number of new integration sites in each survey, and accounting for the number of previously identified integration sites, the approximate number of unique integration sites in a population could be calculated. In an example calculation, five surveys were performed and a clonality of $7.2 \times 10^3$ unique integration sites was calculated. The more surveys that are performed, the larger N will become, improving the accuracy of the clonality estimate, so this is a minimum estimate. Clonality was similar for cultures SVM-B and SVM-C. Sequencing confirmed that there was no evidence of cross contamination between independent cultures, as no identical integration sites were identified between the three mutagenized cultures. These data showed that there was a highly polyclonal starting population prior to selection for androgen independence.

In Vitro Screen to Identify Genes that Influence Androgen-Independence

To model the clinical progression to advanced AIPC [22] in vitro, a previously established method to select for cells that become androgen-independent in culture was used [11,14,15]. In this model, androgen-dependent LNCaP cells are cultured in charcoal/dextran-treated fetal bovine serum (CT-FBS) which is essentially devoid of androgen. This selects for those cell clones that have a proliferative advantage in an androgen-deficient environment (FIG. 1B). The human LNCaP cell line has several advantages for this screen including expression of androgen receptor, androgen-dependent growth, a demonstrated ability to develop androgen-independent growth [11,14,15], and the ability to form tumors in vivo [16,23] to allow exploration of genes and gene pathways that mediate progression in vivo. Preliminary experiments showed that transfer of LNCaP cells into media supplemented with 10% CT-FBS led to a loss of cells which would have reduced the clonality of the LV-mutagenized library of insertion sites. It was found that initial culture in 9.75% CT-FBS with 0.25% untreated FBS minimized cell loss. Thus LV-mutagenized and control cells were cultured in media supplemented with 9.75% CT-FBS with 0.25% untreated FBS for approximately 140 days prior to moving cultures to media supplemented with 10% CT-FBS. At this time shuttle-vector mutagenized androgen-dependent LNCaP cells were maintained in an androgen-deficient environment with CT-FBS. After 211 days, the SVM-A culture showed an increase in growth rate compared to control cultures, and was deemed androgen-independent (FIG. 1B). It was hypothesized that in the SVM-A culture, cells with LV proviruses near genes that influenced progression to AIPC had a selective advantage and this led to androgen-independent growth in the SVM-A culture prior to control cultures. This is expected to lead to an over-representation of cells with proviral integrants near genes that influence AIPC. Thus, analysis of provirus integration sites in these androgen-independent cells should identify dysregulated genes near vector proviruses that may mediate progression to AIPC. Genomic DNA was isolated from LV-transduced androgen-independent cells to identify candidate AIPC progression genes by shuttle vector rescue (FIG. 1C).

Figure 2B:
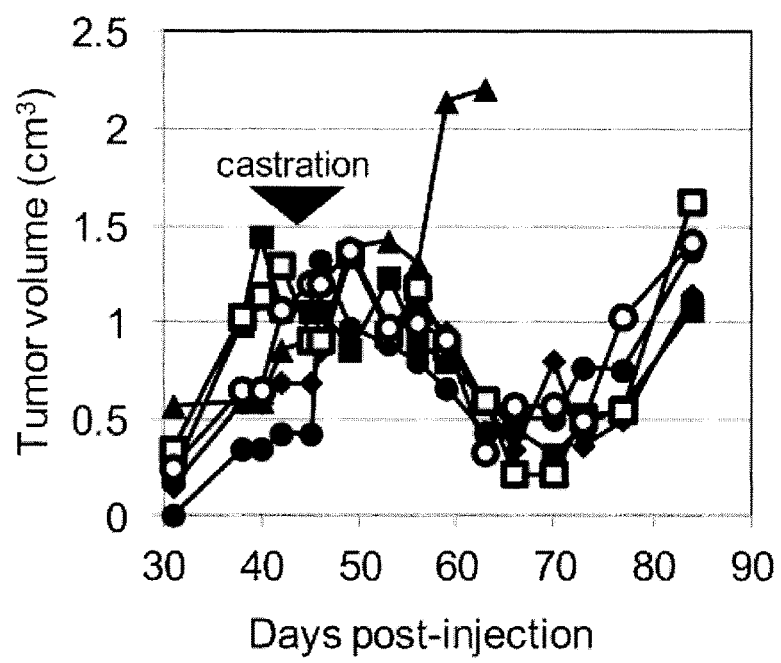

In Vivo Xenotransplant Approach to Identify Genes that Influence Androgen-Independence In vitro models lack the ability to identify genes involved in processes required only in vivo such as vascularization. Thus the LV shuttle vector screen was also performed in vivo using a LNCaP xenograft model [16,23]. NOD.Cg-Prkdc$^{scid}$Il2rg$^{tm1wjl}$/SzJ (NSG) mice are severely immunocompromised, and allow for efficient engraftment of human cells [24]. Androgen-dependent control LNCaPs and mutagenized SVM-A cells prior to selection in vitro were injected into male NSG mice (FIG. 2A). Tumors developed from the injection of both SVM-A and control LNCaP cells. Similar to androgen-dependent tumors in PC patients, it was expected that tumor volumes would regress following androgen deprivation therapy. In patients, this is done by either a surgical or chemical castration [22]. In the in vivo model, this environment was created by surgical removal of the testes which are the primary source of androgens. It was expected that tumor size would decrease immediately following castration and similar to the in vitro model, the androgen-deficient environment would select for androgen-independent cells modeling what occurs in PC patients [11,12]. LNCaP cells were injected in male NSG mice and formed in 6 of 7 injected mice (FIG. 2B). Tumors did regress following castration and following the castration, tumor growth resumed. Tumors were allowed to grow until they reached volumes larger than the tumor size prior to castration, at which point tumors were harvested and genomic DNA was obtained for shuttle vector rescue analysis.

Identification of Genes Near LV Integration Sites Isolated from In Vitro Androgen-Independent Cultures and Subcutaneous Tumors from Castrated Mice Rescue of genomic DNA from the androgen-independent culture SVM-A in vitro samples post-selection recovered a total of 21 unique sites. From two in vivo tumors analyzed post-castration, a total of 54 insertion sites was identified, 27 from one tumor and 28 from the second with one site found in both tumors. All sites were single insertion sites. Custom PERL computer programs were used to analyze whether the provirus integrated within a RefSeq gene and to also provide the distance from the integration site to the nearest 3 Refseq gene transcription start sites (TSS). Only genes that had a TSS within 100 kb of the vector provirus were considered.

Figure 3:
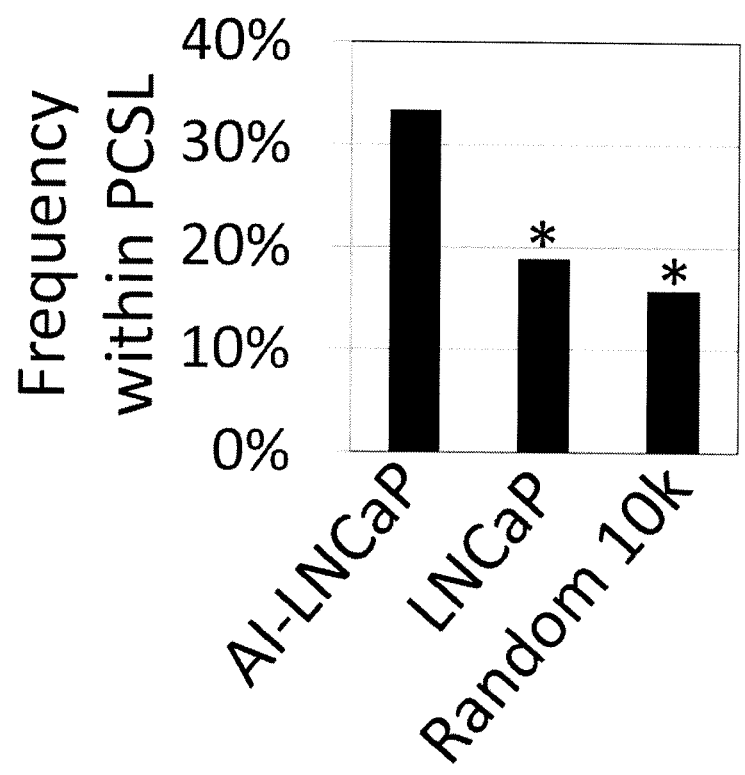
FIG. 3. LV integrants are enriched in PC susceptibility loci after selection for androgen-independence. Lentiviral integration sites (75) identified from LNCaP androgen-independent cultures in vitro or tumors from castrated animals (AI-LNCaP) were mapped relative to previously described PC susceptibility loci (PCSL). The frequency of these sites was compared to LNCaP cells pre-selection (LNCaP) and to a control data set of 10,000 random sites. *indicates significant difference of $p<0.001$.

Enrichment of Vector Proviruses within PC Susceptibility Loci after Selection for Androgen-Independence It was hypothesized that this approach should enrich for vector integration sites near regions known to be involved in PC progression. The 75 integration sites were mapped relative to previously described PC susceptibility loci and compared to 412 control integration sites obtained from transduced LNCaP cells prior to selection for androgen-independence, and also to a random in silico generated data set of 10,000 sites (FIG. 3). The percent of vector integrations within PC susceptibility loci for LNCaP cells cultured in androgen-deficient medium was significantly higher than from the LNCaP cells prior to culture in androgen-deficient culture medium (p<0.001) and also significantly higher than from the random sites (p<0.001). This demonstrates a significant enrichment of vector proviruses near loci previously associated with PC when cells are grown under androgen-deficient conditions.

Meta-Analysis of Expression of Candidate PC Genes Near Vector Proviruses

Figure 4:
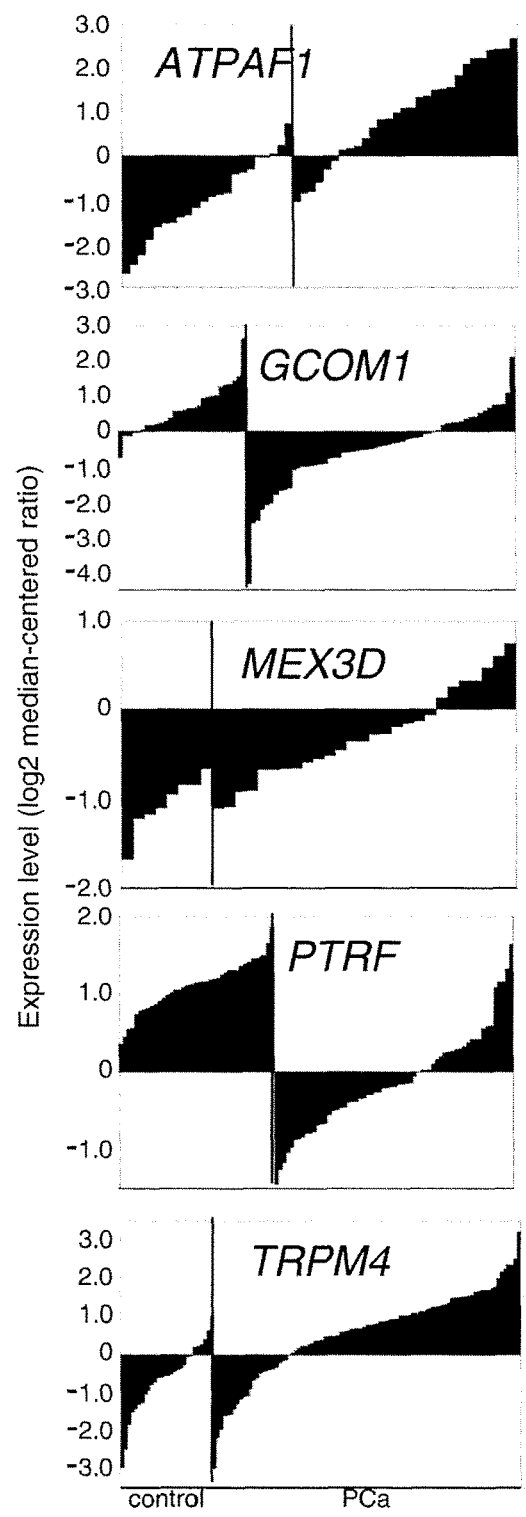
FIG. 4. Differential expression in normal prostate tissue vs. PC tissue for candidate AIPC genes. Oncomine™ (Compendia Bioscience, Ann Arbor, Mich.) was used for analysis and visualization. The Oncomine™ database was queried using gene names for ATPAF1, GCOM1, MEX3D, PTRF, and TRPM4 using the Cancer vs. Normal Analysis, and selecting PC vs. Normal analysis. This provides gene expression levels in healthy prostate tissue (left side, control), and prostate carcinoma or prostate adenocarcinoma tissue samples (right side, PC). The data is represented here as waterfall plots for each different gene.

Data from previously published microarray analysis of patient tumors was used to identify the genes in the dataset that were most likely to contribute to AIPC based on dysregulation in patient tumors. This approach has the advantage that multiple data sources may improve the power of the screen, and may improve the ability to identify genes that are clinically relevant due to their dysregulation in patient tissues. Oncomine™ (Compendia Bioscience, Ann Arbor, Mich.) [25] was used to compare microarray data from 16 different studies [26-39] that evaluated gene expression in normal prostate tissue vs. PC tissue (prostate carcinoma or prostate adenocarcinoma) to evaluate the candidate progression genes identified near vector proviruses. It was reasoned that candidate driver genes identified in this screen were likely to be over or under-expressed in PC tissue and that meta-analysis of previously published microarray studies would be a powerful way to screen these candidates for driver genes likely to be potential biomarkers or therapeutic targets. To evaluate over or under-expression both the rank and a multiple comparisons-corrected p-value as calculated by Oncomine™ was used. Candidate genes with p-values <0.005 and ranks less than 1000 in either the over- or under-expression multiple comparisons were considered as potential driver genes (Table 2). AIPC genes identified from the androgen-independent in vitro culture were ATPAF1 (ATP synthase mitochondrial F1 complex assembly factor 1) and TRPM4 (transient receptor potential cation channel, subfamily M, member 4). AIPC genes identified from the androgen-independent in vivo tumor were GCOM1 (GRINL1A complex locus 1), MEX3D (mex-3 RNA binding family member D), and PTRF (polymerase I and transcript release factor). Three of these genes, ATPAF1, MEX3D and TRPM4, are over-expressed in PC tissue, while two are under-expressed, GCOM1 and PTRF (FIG. 4). The locations of the five vector integrants were mapped relative to genomic loci using the University of California, Santa Cruz (UCSC) Genome Browser.

TABLE 2

AIPC genes

| Gene | Source | In gene/distance | PCSL | Expression | p-value |
| --- | --- | --- | --- | --- | --- |
| ATPAF1 | In vitro | yes | none | over | 0.002 |
| GCOM1 | In vivo | yes | none | under | 0.003 |
| MEX3D | In vivo | 32,561 | 19p13.3 | over | 9.70E-04 |
| PTRF | In vivo | 62,474 | 17q21-22 | under | 0.003 |
| TRPM4 | In vitro | yes | near 19q13.4 | over | 1.13E-04 |

Table 2 lists AIPC genes identified from provirus integration sites recovered from both the in vitro mutagenesis screen and the in vivo subcutaneous tumor model. Source indicates whether the gene was identified from the in vitro screen or the in vivo screen. In gene/distance indicates whether the LV provirus was within the gene transcription unit, or if outside the transcription unit indicates the distance in base pairs from the proviral integration to the transcription start site of the gene. PCSL indicates if the provirus was within or near a PC susceptibility locus. Expression indicates if the gene was over or under-expressed in PC tissue using the Oncomine™ database. Rank is the Oncomine™ ranking of over or under-expressed genes. p-value is the Oncomine™ p-value for over or under-expression.

Figure 5:
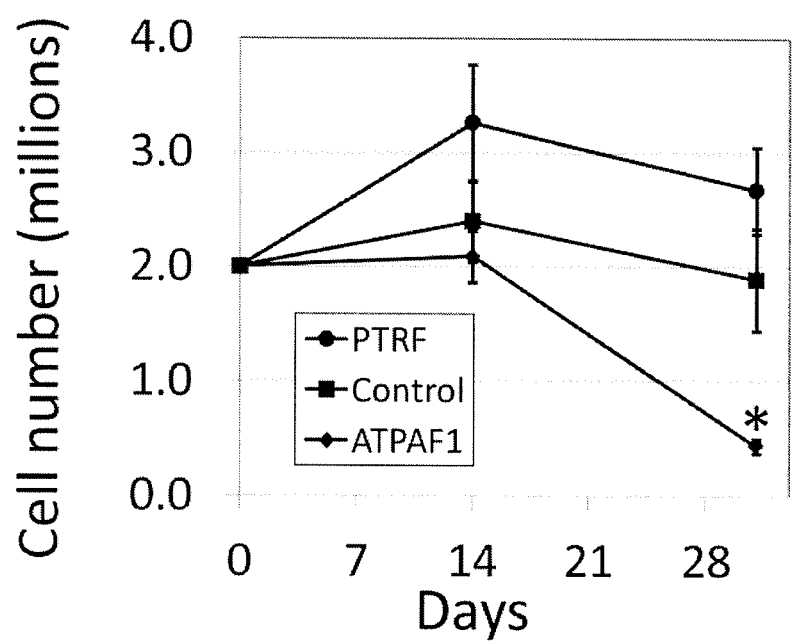
FIG. 5. Validation using LV-mediated knockdown. LNCaP cells were transduced with a pGIPZ lentiviral vector expressing a shRNA targeting either ATPAF1, PTRF, or a control empty vector. Vector-exposed cells were selected using puromycin to eliminate untransduced cells. Transduced cells were then cultured in androgen-deficient medium to determine if knockdown of ATPAF1 or PTRF affected growth.
Figure 7A:
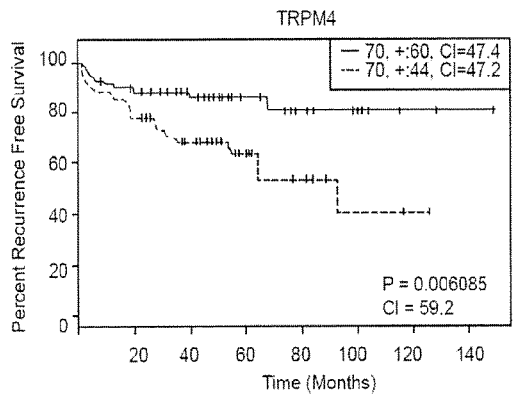
FIG. 7A-E. Kaplan-Meier survival graphs showing that the expression level of genes identified in the mutagenesis screen can predict recurrence-free survival after prostatectomy. The ability of individual genes (A. TRPM4; B. GCOM4; C. PTRF; D. ATPAF1; E. MEX3D) to predict recurrence-free survival. The lower lines are high risk patients as identified by expression levels of the indicated genes. The upper lines are low risk patients as identified by expression levels of the indicated genes.
Figure 7B:
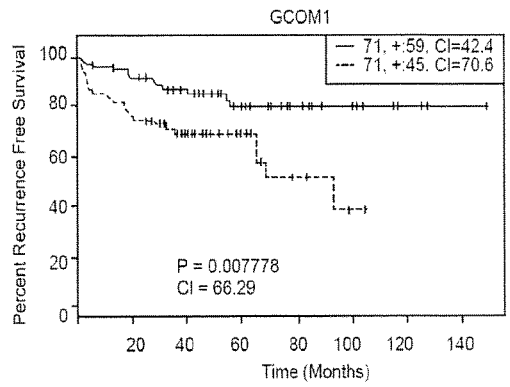
Figure 7C:
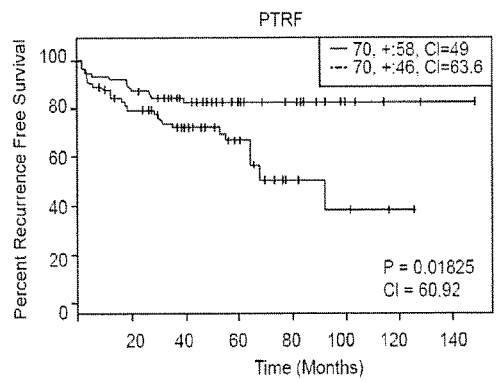
Figure 7D:
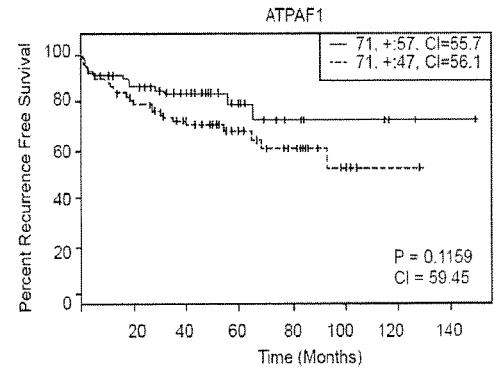
Figure 7E:
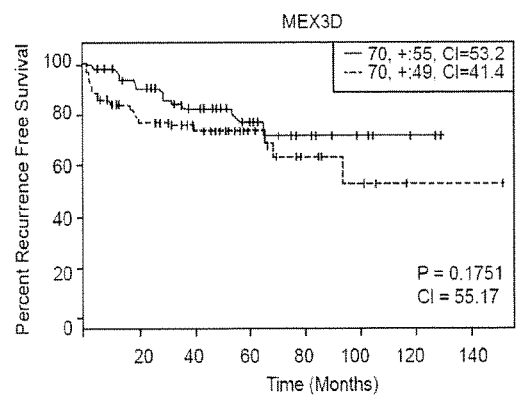
Figure 8A:
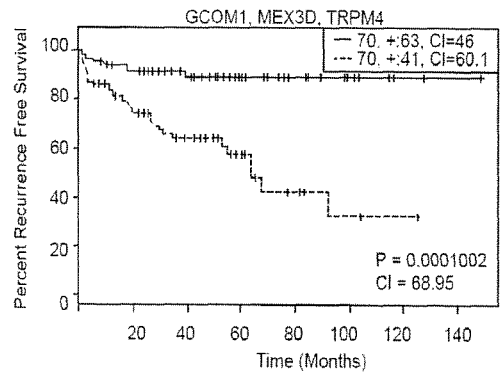
FIG. 8A-D. Kaplan-Meier survival graphs showing that the expression level of genes identified in the mutagenesis screen can predict recurrence-free survival after prostatectomy. The ability of gene combinations (A. GCOM1, MEX3D, and TRPM4; B. ATPAF1, TRPM4, GCOM1, and MEX3D; C. ATPAF1, MEX3D, and PTRF; D. GCOM1, PTRF, and TRPM4) to predict recurrence-free survival. The lower lines are high risk patients as identified by expression levels of the indicated genes. The upper lines are low risk patients as identified by expression levels of the indicated genes.
Figure 8B:
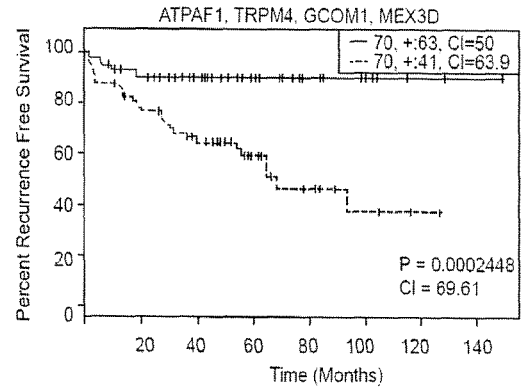
Figure 8C:
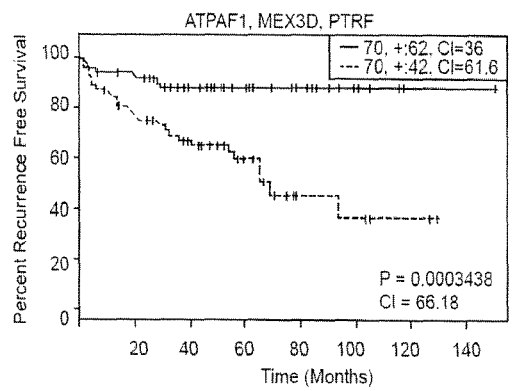
Figure 8D:
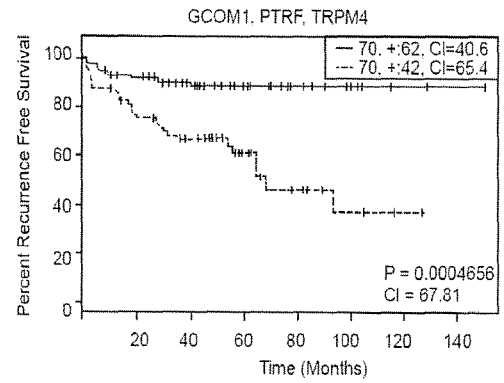

Validation of Genes Involved in AIPC by RNAi Knockdown Confirms Involvement of ATPAF1 in PC Progression To validate the effects of ATPAF1 and PTRF on androgen-independence, LV-mediated RNAi was used. For ATPAF1 and PTRF, a set of commercially available pGIPZ LV vectors targeting different sites on each gene were first screened to find an efficient shRNA target. The pGIPZ vector with the most effective shRNA was then used to transduce LNCaP cells. Cells were then cultured with puromycin to eliminate untransduced cells. Knockdown was confirmed by RT-PCR and then puromycin-resistant cells were cultured under androgen-deficient conditions to select for androgen-independence. PTRF is under-expressed in PC tissue, so PTRF knockdown was expected to lead to more rapid proliferation under androgen-deficient conditions. Conversely, ATPAF1 is overexpressed in PC tissue, so knockdown of this gene should impair proliferation under androgen-deficient conditions. After 31 days of culture in androgen-deficient medium, as expected knockdown of PTRF resulted in higher cell numbers than cells transduced with the control vector, however the increase did not reach statistical significance (p=0.25) (FIG. 5). Knockdown of ATPAF1 resulted in significantly fewer cells in androgen-deficient medium than the control by day 31 of culture ($p<0.05$).

Candidate Genes Predict the Clinical Outcome of Prostate Cancer Patient

The genes identified in this screen can be used as prognostic biomarkers to predict outcome. To identify gene sets that would efficiently predict clinical outcome, the prognostic ability for each gene was independently explored (FIG. 7A-E) as well as combinations of genes that could predict recurrence free survival (FIG. 8A-D). The expression levels of several gene combinations from genes identified in the screen were able to very accurately predict recurrence free survival ($p<0.001$). Overall this data demonstrates that the candidate genes identified in the screen are of prognostic value and can predict recurrence free survival of PC patients after prostatectomy.

Discussion

PC remains a significant health problem and a leading cause of cancer related death in the United States and parts of Europe [8,9]. However, many of PC's molecular mechanisms remain elusive. Though treatable in its early, androgen-dependent stages, PC often progresses to a lethal, untreatable, androgen-independent form. Here, it is reported for the first time, a retroviral mutagenesis screen using a replication-incompetent LV vector to identify genes that mediate progression to AIPC. This shuttle vector approach efficiently recovered integration sites that could be rapidly mapped to genomic loci. A strong enrichment of provirus integrations in PC susceptibility loci was observed when integration sites were compared between transduced cells prior to culture in androgen-deficient medium and after cells had become androgen-independent. This suggests that integrated vector proviruses dysregulated nearby genes that allowed these clones to proliferate in the absence of androgen, and provided a selective advantage resulting in their enrichment in a polyclonal population. While this has been widely exploited for retrovirus mutagenesis screens, it was shown here for the first time that a replication-incompetent LV can be used to identify genes that mediate AIPC. By performing meta-analysis of the data with patient data, five AIPC genes were identified from 75 unique integration sites.

Retroviral mutagenesis identifies driver genes by dysregulating genes near vector proviruses that provide a selective advantage. It also models a major mechanism for PC, the formation of double-strand breaks (DSBs) (FIG. 6A-C) which can result in gene fusions such as TMPRSS-ERG [48,49]. These gene fusions often place constitutively active promoters next to oncogenes, resulting in activation of an oncogene. LV-based mutagenesis can model mutations caused by DSBs as a strong viral promoter/enhancer was used to dysregulate neighboring genes, analogous to the juxtaposition of strong promoters to nearby proto-oncogenes (FIG. 6C).

Using a replication-incompetent LV shuttle vector has several advantages. LVs can be produced at high titer and the vesicular stomatitis virus glycoprotein used to pseudotype the LV has a broad tropism allowing for efficient transduction of essentially any target mammalian cell. Thus this approach can be used to identify genes involved in numerous oncogenic processes. For example, such a screen could be used to identify genes involved in the progression to metastatic breast cancer. Further, the approach can be used to identify genes involved in virtually any biological process that involves cells that undergo a selective pressure. A novel advantage of this approach is in the method of recovery of the provirus integration site. Previous mutagenesis screens have used PCR to detect proviral integrations but PCR is limited in its ability to identify rare or poorly amplified insertions [1]. Additionally, PCR sequence read lengths are shorter than those recovered using a shuttle vector rescue technology [21]. The longer sequence reads provided by shuttle vector allow for a more accurate localization of the provirus integration.

The screen described herein identified five PC progression genes; ATPAF1, GCOM1, MEX3D, PTRF, and TRPM4. TRPM4 has been associated with the development of a cancer phenotype, particularly with cell proliferation and tumor progression [50,51], and has been specifically shown to enhance cell proliferation through up-regulation of the β-catenin signaling pathway [50,52]. GCOM1 is a locus with a naturally occurring read-through transcription event, with one transcript encoding a fusion protein [53]. Interestingly GCOM1 was identified as an estrogen receptor β (ERβ) target gene [54]. Estrogen receptors appear to play an important role in PC and ERβ is expressed in the prostate gland [55]. ERβ is the main target for phytoestrogens, and may play a role in the difference in incidence of PC in the Western world compared to Asia where the intake of soy-based, phytoestrogen-rich food is higher [55]. PTRF has been associated with a number of different functions in the prostate and in cancer. In PC, PTRF expression has been shown to alter the aggressiveness of the cancer [56]. PTRF has also been shown to be decreased significantly in LNCaP and PC3 cells and in cancer tissue [57]. PTRF is involved in the formation of caveolae, invaginations of the plasma membrane [58,59]. PTRF is also involved in localization of caveolin-1, which is involved in PC severity, aggressiveness, metastasis, and androgen sensitivity [58]. Additionally, PTRF is under-expressed in PC, and its expression can actually attenuate PC disease severity and aggressiveness [58].

While these genes have been previously associated with cancer or prostate physiology, the screen described herein was also able to identify novel genes not previously associated with cancer or prostate physiology. MEX3D, is a member of the Mex-3 subfamily of conserved RNA-binding proteins, which are involved in post-transcriptional regulation [60]. MEX3D was previously associated with chemotherapy-induced oral mucositis in acute myeloid leukemia patients [61]. ATPAF1 encodes an assembly factor for the F1 component of the mitochondrial ATP synthase, which is required for assembly of the ATP synthase $F_1$ complex in oxidative phosphorylation [62]. ATPAF1 is widely expressed in host tissues, but has never been specifically linked to cancer. However, another mitochondrial protein involved in mitochondrial oxidative phosphorylation, ATPase inhibitory factor 1 (ATPIF1) mediates the metabolic shift of cancer cells to a Warburg phenotype and has been identified as a promising predictive marker for clinical outcome in breast and colon cancer [63].

The data provided herein suggests an involvement of both PTRF and ATPAF1 in AIPC. ATPAF1 knockdown resulted in significantly decreased growth relative to controls, however the increase in growth was not significant for PTRF knockdown. PTRF expression is decreased in PC cells, including LNCaP and PC-3 [57]. It was speculated that because the level of PTRF expression in LNCaP cells is normally low, that any effect from knockdown by RNAi is limited. The data provided herein also demonstrates that the candidate genes identified in the screen are of prognostic value and can predict recurrence free survival of PC patients after prostatectomy.

Example 2. Lentiviral Vector-Mediated Insertional Mutagenesis Screen Identifies Genes that Influence Androgen Independent Prostate Cancer Progression and Predicts Clinical Outcome

SUMMARY

Herein an insertional mutagenesis screen was performed using a replication-incompetent lentiviral vector (LV) to identify genes that promote AIPC. Androgen sensitive PC cells, LNCaP, were mutagenized with the LV and orthotopically injected into the prostate of male mice. In the screen described in Example 1, the mutagenized cells were injected subcutaneously into the right flank of the mice. After tumor development, mice were castrated to select for cells that proliferate in the absence of androgen. Proviral integration sites and nearby dysregulated genes were identified in tumors developed in an androgen deficient environment. In this Example, as opposed to Example 1, integration sites were detected by modified genomic sequencing PCR (MGS-PCR). Using publically available datasets, the expression of these candidate androgen independence genes in human PC tissues were analyzed. A total of 11 AIPC genes were identified: GLYATL1, FLNA, OBSCN, STRA13, WHSC1, ARFGAP3, KDM2A, FAM83H, CLDN7, CNOT6 and B3GNT9. Seven out the 11 genes; GLYATL1, OBSCN, STRA13, KDM2A, FAM83H, CNOT6 and B3GNT6, have not been previously implicated in PC. Additionally, it was shown that a combination of four genes, OBSCN, FAM83H, CLDN7 and ARFGAP3 was the more preferred gene cluster for predicting the recurrence risk in PC patients after prostatectomy ($P=5.3\times10^{-5}$).

Introduction

Herein an insertional mutagenesis screen in an orthotopic xenograft mouse model is reported to identify genes involved in AIPC. In this approach, mutagenized-LNCaP cells were directly injected into the prostate of male immunodeficient mice. After tumors formed, mice were castrated to select for androgen independent tumors in vivo, modeling what occurs in PC patients. This human xenograft PC orthotopic model has the advantage that genes that promote AIPC in the prostate microenvironment can be identified [23, 71]. Several genes were identified using this screen and their ability to predict recurrence after ADT was established.

Materials and Methods

Cell Line Culture, Vector Production, and Transduction

The androgen-dependent human prostate carcinoma cell line LNCaP-FGC (ATCC CRL-1740) that was previously transduced with the LV vector LV-SFFVEGFP was described in Example 1 [72]. LV-SFFVEGFP, contains self-inactivating (SIN) long terminal repeats (LTRs) and a spleen focus forming virus (SFFV) promoter driving enhanced green fluorescent protein (EGFP). It also contains an R6Kγ origin of replication and kanamycin resistance genes (FIG. 1A).

Orthotopic Prostate Cancer Mouse Model

Male 4-8 week old NSG mice were obtained from the Jackson Laboratory (Bar Harbor, Me.). For orthotopic injection, mice were anesthetized via isoflurane gas. A small incision of approximately 1 cm was made in the lower abdomen through the skin and peritoneum to expose the prostate gland. $1\times10^6$ LV-mutagenized LNCaP cells in 20 µL, RPMI 1640 plus 5% FBS plus 100 µL, Matrigel (BD Biosciences, Bedford, Mass.) were inoculated via orthotopic injection into the dorsal or ventral prostate using a 27 gauge needle. Wound clips were placed over the incision to seal the wound for recovery. Mice were monitored daily for initially 3 days following surgery and then every 3 days over the course of the experiment. Tumor growth was monitored and measured by vernier calipers every 3 days. To provide an androgen-deficient environment for the selection and growth of androgen-independent tumors, mice were castrated via the scrotal approach. Following castration, tumor growth was monitored. Once primary tumors reached sizes larger than their size prior to castration tumor tissue was harvested. Genomic DNA was obtained from tumor tissue using the Puregene® Cell and Tissue Kit (Qiagen Inc., Valencia, Calif.).

MGS-PCR Sequencing and Identification of Integration Sites

Integration sites were identified using the deep sequencing technique known as modified genomic sequencing (MGS)-PCR as previously described [73] with minor alterations, most notably the use of hydroshear vs acoustic shearing technique for DNA shearing. Two primary tumors from two castrated mice were collected and processed for MGS-PCR sequencing. Approximately 4 million sequence reads were obtained per tumor. The VISA retroviral integration site analysis server [74] was used to identify vector-chromosome junctions and determine integration site locations within the human genome (hg38) as well as identify nearby genes and promoters. Custom PERL programming was used to further identify the closest genes with transcriptions start sites (TSS) within 50 kbp of insertions. Only alignments that had a LTR-chromosome junction and met additional strict criteria as previously described [21] were considered as integrations.

Figure 9A:
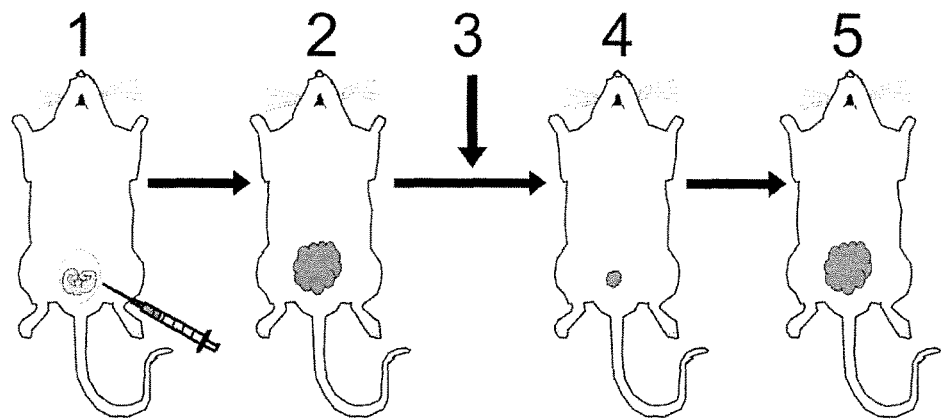
FIG. 9A-B. LV-Insertional mutagenesis screen to identify genes involved in androgen-independent prostate cancer using a orthotopic mouse model. A) Orthotopic model showing 1) injection of LV-mutagenized LNCaP cells into the prostate gland of a male NSG mouse, 2) tumor development, 3) surgical castration, 4) regression of tumor and 5) re-growth of androgen-independent tumor. B) In vivo tumor growth: Tumor volumes at various time points before and after castration in mice injected with LV-mutagenized LNCaP cells were plotted. Dotted line indicates the castration time.
Figure 9B:
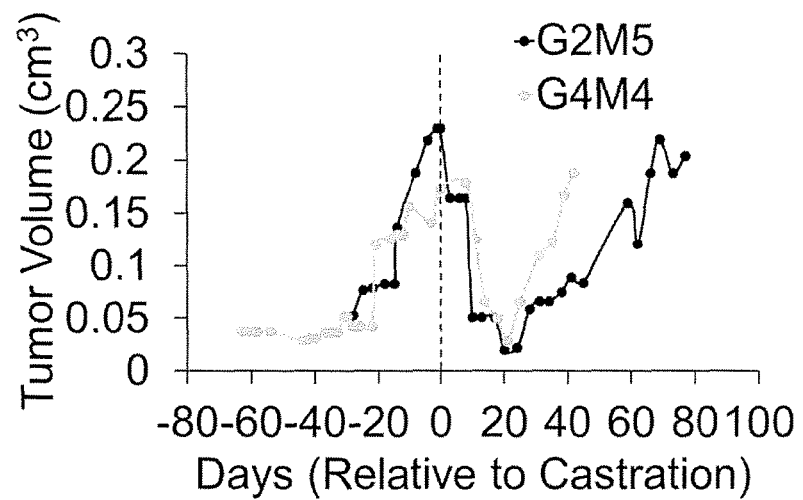

Candidate Gene Identification and Analysis cDNA microarray datasets available in the Oncomine database [25] were used to systematically assess the differential expression of genes identified in the mutagenesis screen. cBioportal of cancer genomics was used to examine the genetic alteration of the candidate genes in prostate cancer samples [75]. To investigate the clinical outcome and prognostic relevance of the candidate genes, the online biomarker validation tool Survexpress was utilized [68].
Results
LV Mutagenized LNCaP Cells Induce Androgen Independent Orthotopic Tumors in Mice It was shown in Example 1 that novel AIPC genes could be identified in vitro and in subcutaneous tumors using a replication-incompetent LV [72]. In this study, LV was used to induce mutations in LNCaP cells, an androgen dependent prostate cancer cell line, and investigate the genes associated with androgen independent growth. LNCaP cells transform into androgen independent cells (LNCaP-AI), potentially by acquiring genetic alterations (activation of oncogenes and suppression of tumor suppressor genes). Herein a screen was developed to identify AIPC genes using orthotopic tumors that can identify genes that are involved in the PC microenvironment. LV-mutagenized LNCaP cells were injected into NSG mice and formed tumors in approximately 20 days post injection (FIG. 9). Once the tumor volumes were over 0.2 cm², mice were surgically castrated. Post-castration the tumors regressed, as measured by the tumor volumes (FIGS. 9A and 9B). As expected, after 3-4 weeks of initial regression the tumors re-grew in the castrated mice, modeling what occurs in human PC patients treated with ADT. AIPC tumors that regrew in castrated mice, were collected from the mice to analyze LV-vector integration sites and nearby candidate AIPC genes.

LV Proviral Integration Site Analysis and Identification of Nearby Genes

Genomic DNA isolated from primary tumor and lung-metastatic samples were analyzed for provirus integration sites using modified genomic sequencing (MGS)-PCR. Sequence reads were mapped to the human genome (hg38) using the Vector Integration Site Analysis (VISA) bioinformatics server [74]. More than 459,000 vector-chromosome junctions were identified from over 4,657,000 total sequence reads. A total of 394 unique proviral integration sites were recovered from the two tumors. The unique integration sites were captured at varying frequencies ranging from one to 78,139 times. To prioritize the integration sites, the top 20% of captured integration sites from each tumor comprising a total of 79 unique integration sites were selected for additional analysis. Genes near the provirus integration were determined by two criteria: 1) genes containing an integration and 2) the three closest genes with transcription start sites (TSS) within 50 kb of a provirus integration site.

Meta-Analysis of Genes Near Vector Proviruses to Identify Candidate PC Genes

To identify which genes near vector proviruses are candidate AIPC genes, their expression in prostate cancer patient tumors was explored using publically available microarray data (Oncomine) [25]. Oncomine comprises a collection of more than 16 gene-expression datasets related to PC alone. To reduce the biases of an individual study/dataset, a meta-analysis of 16 different datasets was performed to determine the differential expression pattern of the genes in normal human prostate tissues and human PC tissues. Only genes with p-values<0.01 and gene rank less than 2,000 were considered as potential candidate genes (Table 3). The candidate genes identified were GLYATL1, FLNA, STRA13, WHSC1, FAM38H, CLDN7, CNOT6, and B3GNT6. Genes GLYATL1, STRA13, WHSC1, FAM83H, CLDN7 and CNOT6 were significantly upregulated in PC tissues compared to normal tissue, whereas FLNA and B3GNT6 were under expressed in PC tissue (Table 3).

TABLE 3

Meta-analysis of the candidate genes across 16 different datasets

| Chromo-some | Candidate Gene | Integration in/near gene | Expression pattern | p-value | Previously implicated with prostate cancer (*other cancers) |
|---|---|---|---|---|---|
| Chr11 | GLYATL1 | In | Over | 0.0000178 | No* |
| Chr1 | OBSCN | CISs | Under | 0.00002 | No* |
| ChrX | FLNA | 2.1 kb | Under | 0.001 | Yes |
| Chr17 | STRA13 | 22.7 kb | Over | 0.001 | No* |
| Chr8 | FAM83H | 10.8 kb | Over | 0.005 | No* |
| Chr4 | WHSC1 | In | Over | 0.005 | Yes |
| Chr17 | CLDN7 | 5.1 kb | Over | 0.006 | Yes |
| Chr5 | CNOT6 | In | Over | 0.008 | No |
| Chr16 | B3GNT9 | 9.4 kb | Under | 0.009 | No |
| Chr11 | KDM2A | CISs | Under | 0.044 | No* |
| Chr22 | ARFGAP3 | CISs | Over | 0.063 | Yes |

Columns 1 and 2 of Table 3 indicate the chromosome and the candidate gene. Column 3 indicates whether the LV provirus integrated within gene or has a gene TSS within the distance indicated or has multiple integrations (common integration sites, CISs). Columns 4 and 5 indicate the expression of the candidate gene in prostate cancer patients and the corresponding p-value from the meta-analysis. Column 6 indicates whether the gene was previously reported to be associated with prostate cancer (* gene is associated with other cancer).

Three CISs within chromosomes 1, 11 and 22 was also identified. In chromosome 1, two integration sites were observed in the gene OBSCN, which are separated by ~30.3 kb (Table 4). In chromosome 11, proviruses integrated at three distinct sites within a window of 78.6 kb in the gene KDM2A (Table 4). In chromosome 22, proviruses were observed in the ARFGAP3 gene twice within a window of 5.9 kb (Table 4). These three CISs within OBSCN, KDM2A and ARFGAP3 genes had no other gene TSS within 50 kb of the CISs (Table 4). These three genes were also included in the list of candidate AIPC genes based on the presence of a CIS.

TABLE 4

List of CISs identified by insertional site analysis

| Chr | No. of Integrations | Integration site (bp) | Maxiumium distance between insertions (bp) | Candidate genes |
|---|---|---|---|---|
| 1 | 2 | 228264130 228233817 | 30313 | OBSCN |
| 11 | 3 | 67123540 67132312 67202202 | 78662 | KDM2A |
| 22 | 2 | 42817724 42823647 | 5923 | ARFGAP3 |

Columns 1 and 2 are the chromosome and number of integrations identified within a range of 100 kb. Columns 3 and 4 are positions of CIS on the genome and distance between the integration sites. Column 5 lists the genes in or near the CIS.

Candidate Genes are Recurrently Altered in Prostate Cancer Patients

Figure 10:
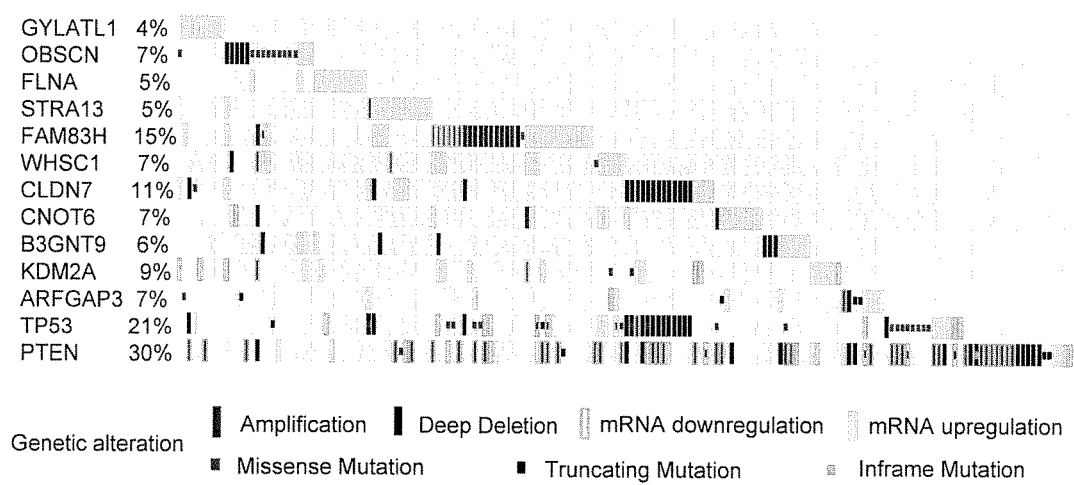
FIG. 10. Oncoprint data showing distinct genetic alteration in candidate genes in 257 prostate cancer patients using data from TCGA dataset. Genetic alteration of TP53 and PTEN; most frequently altered genes in prostate cancer were also examined as a comparison. Each tumor sample is represented by a bar. Only patients with alterations were shown (from 257 samples). Frequency of gene alteration is represented in a percentage.

To investigate whether the candidate genes identified herein are genetically altered in PC patients, distinct genetic alterations were examined including mutations, copy number variations and mRNA expression levels in prostate cancer patients in the TCGA dataset using tools available in cBioPortal of Cancer Genomics [75]. The TCGA dataset was chosen because it has all three of these data, and it has a large number of patient tumors (257). This analysis showed that all 11 candidate genes had genetic alterations in prostate cancer patients. Among the candidate genes, it was observed that FAM83H gene was most frequently altered. 39 out of 257 (15%) of prostate cancer patients showed genetic alteration in FAM83H, out of which 36 tumors had either copy number gain (amplification) or mRNA upregulation, while the remaining three tumors each had a copy number loss, missense mutation or truncated mutation in FAM83H gene (FIG. 10). For comparison, TCGA showed 21% and 31% of tumors have alterations in TP53 and PTEN, respectively. Moreover, FAM83H was also altered in prostate cancer patients across five other datasets available in cBioPortal.

Analysis of TCGA showed that 11-4% prostate tumor samples showed genetic alteration in CLDN7, KDM2A, ARFGAP3, OBSCN, CNOT6, WHSC1, B3GNT9, FLNA, STRA13 and GLYATL1, respectively (FIG. 10). The occurrence of genetic alteration in PC patients in five other datasets available in cBioPortal was also queried. OBSCN, CLDN7 and STRA13 were frequently altered among PC patients in at least 4 of 7 published datasets. In summary, it was demonstrated that all 11 genes identified in this screen were recurrently altered in PC patients, implicating these genes in PC progression.

Candidate Genes Predicted the Clinical Outcome of Prostate Cancer Patient

Figure 11A:
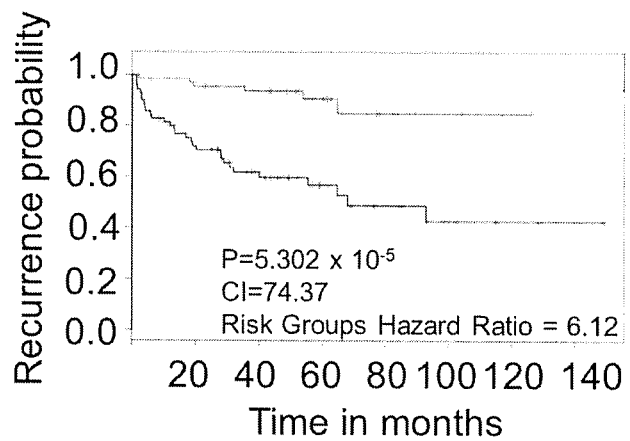
FIG. 11A-B. Kaplan-Meier curves showing the ability of the candidate genes to predict the recurrence risk in prostate cancer patients. Dataset generated from A) [34] and B) [76]. The combination of OBSCN, FAM83H, CLDN7 and ARF-GAP3 genes stratified the cohorts into high risk (lower line) and low risk (upper line) groups. Patients in high risk groups showed poor prognosis. Further, the combination of the four genes showed a high ability to predict the recurrence risk in the prostate cancer patients treated by prostatectomy (p-value $5.302 \times 10^{-5}$).

It was investigated whether the expression levels of the candidate genes identified in the screen correlated with clinical outcome of prostate cancer patients using SurvExpress. Based on the differential expression of the gene(s) in PC patients, the tool stratifies the patient samples into low and high risk groups and derives Kaplan-Meier curves defining the survival risk of the patients. Out of 7 published PC datasets, 2 contained all 11 candidate genes and had expression data from recurrent tumors following radical prostatectomy [34, 76]. The dataset generated by Taylor et al. (2010) [34] had the largest number of patient tumor samples (140) collected from PC patients after treatment and was thus used to determine the prognostic value of the candidate genes in predicting recurrence risk in cancer patients after prostatectomy. To identify gene sets that would efficiently predict clinical outcome, prognostic values for each gene was analyzed independently as well as 2-gene, 3-gene and 4-gene combinations. The combination of OBSCN, FAM83H, CLDN7 and ARFGAP3 was the most effective combination that predicted the recurrence risk of PC patient after treatment, with statistically significant values, p-value=$5.302\times10^{-5}$, Concordance Index=74.37 and risk hazard ratio=6.12 (FIG. 11A and Table 5).

TABLE 5

Relative ability of the candidate genes to predict the recurrence risk in prostate cancer patients

| Gene combinations | p-Value | Concordance Index | Risk groups hazard ratio |
|---|---|---|---|
| OBSCN + FAM83H + CLDN7 + ARFGAP3 | 5.302E−05 | 74.37 | 6.12 |
| OBSCN + CLDN7 + B3GNT9 + ARFGAP3 | 7.988E−05 | 75.14 | 5.3 |
| WHSC1 + CLDN7 + KDM2A + ARFGAP3 | 8.705E−05 | 74.51 | 5.24 |
| OBSCN + CLDN7 + ARFGAP3 | 0.000101 | 74.78 | 5.16 |
| OBSCN + CLDN7 + CNOT6 + ARFGAP3 | 0.000101 | 74.81 | 5.16 |
| CLDN7 + ARFGAP3 | 0.0001031 | 74.05 | 5.16 |
| FLNA + FAM83H + CLDN7 + CNOT6 | 0.0001047 | 74.92 | 4.57 |
| CLDN7 + CNOT6 + ARFGAP3 | 0.0001238 | 74.56 | 5.06 |
| FAM83H + CLDN7 + CNOT6 + ARFGAP3 | 0.0001238 | 74.43 | 5.06 |
| FAM83H + CLDN7 | 0.00013 | 71.05 | 4.63 |

All 11 candidate genes and combinations of at least four-candidate genes were analyzed for their prognostic significance in predicting clinical outcome in prostate cancer patients. Only the top 10 combinations are represented in Table 5.

Figure 11B:
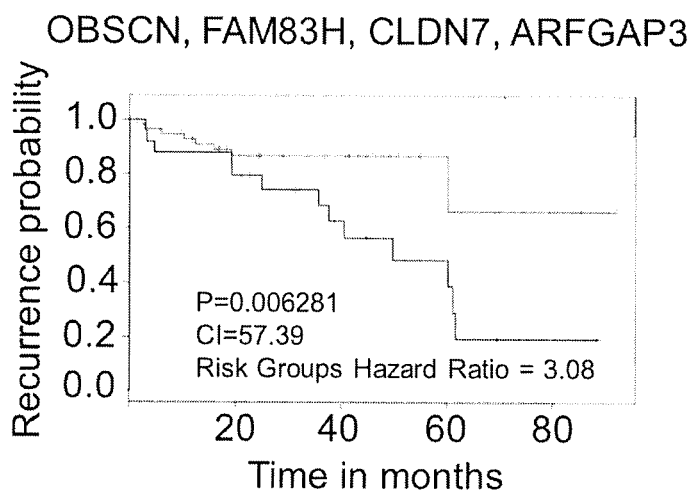

Several other gene combinations, especially the ones with CLDN7 and ARFGAP3 genes, significantly predicted the clinical outcome of PC patients (Table 6). Moreover, this combination (OBSCN, FAM83H, CLDN7, and ARFGAP3) was able to stratify the cohorts available in the second database [76] and predict the clinical outcome of PC patients, p=0.006281 (FIG. 11B). Overall we were able to demonstrate that the candidate genes identified in our screen are of prognostic value that can predict the recurrence risk of PC patients.

TABLE 6

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| OBSCN + FAM83H + CLDN7 + ARFGAP3 | 0.00005302 | 74.37 | 6.12 |
| OBSCN + CLDN7 + B3GNT9 + ARFGAP3 | 0.00007988 | 75.14 | 5.3 |
| WHSC1 + CLDN7 + KDM2A + ARFGAP3 | 0.00008705 | 74.51 | 5.24 |
| OBSCN + CLDN7 + ARFGAP3 | 0.000101 | 74.78 | 5.16 |
| OBSCN + CLDN7 + CNOT6 + ARFGAP3 | 0.000101 | 74.81 | 5.16 |
| CLDN7 + ARFGAP3 | 0.0001031 | 74.05 | 5.16 |
| FLNA + FAM83H + CLDN7 + CNOT6 | 0.0001047 | 74.92 | 4.57 |
| CLDN7 + CNOT6 + ARFGAP3 | 0.0001238 | 74.56 | 5.06 |
| FAM83H + CLDN7 + CNOT6 + ARFGAP3 | 0.0001238 | 74.43 | 5.06 |
| FAM83H + CLDN7 | 0.00013 | 71.05 | 4.63 |
| WHSC1 + CLDN7 + B3GNT9 + KDM2A | 0.0001587 | 75.65 | 4.57 |
| FLNA + FAM83H + CLDN7 + ARFGAP3 | 0.0001774 | 75.68 | 4.53 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| OBSCN + STRA13 + CLDN7 + KDM2A | 0.000183 | 71.05 | 4.5 |
| WHSC1 + CLDN7 + ARFGAP3 | 0.0001895 | 75.33 | 4.48 |
| OBSCN + WHSC1 + CLDN7 + ARFGAP3 | 0.0001895 | 75.41 | 4.48 |
| WHSC1 + CLDN7 + CNOT6 + ARFGAP3 | 0.0001895 | 75.49 | 4.48 |
| STRA13 + CLDN7 + B3GNT9 + ARFGAP3 | 0.0002058 | 74.56 | 4.45 |
| CLDN7 + CNTO6 + B3GNT9 + ARFGAP3 | 0.0002058 | 74.7 | 4.45 |
| STRA13 + CLDN7 + CNOT6 + ARFGAP3 | 0.0002268 | 74.46 | 4.41 |
| FLNA + WHSC1 + CLDN7 + ARFGAP3 | 0.000232 | 75.35 | 4.16 |
| CLDN7 + KDM2A | 0.0002321 | 70.7 | 4.39 |
| GLYATL1 + CLDN7 + B3GNT9 + KDM2A | 0.0002506 | 78.05 | 4.13 |
| CLDN7 + B3GNT9 + ARFGAP3 | 0.0002606 | 74.54 | 4.35 |
| FAM83H + CLDN7 + B3GNT9 + ARFGAP3 | 0.0002606 | 74.78 | 4.35 |
| FAM83H + WHSC1 + CLDN7 + ARFGAP3 | 0.0002688 | 75.03 | 4.33 |
| OBSCN + STRA13 + CLDN7 + ARFGAP3 | 0.0002706 | 74.65 | 4.32 |
| FAM83H + CLDN7 + ARFGAP3 | 0.0002901 | 74.1 | 4.3 |
| FLNA + STRA13 + CLDN7 + ARFGAP3 | 0.0003083 | 75.35 | 4.04 |
| FLNA + CLDN7 + KDM2A + ARFGAP3 | 0.0003083 | 75.52 | 4.04 |
| STRA13 + WHSC1 + CLDN7 + ARFGAP3 | 0.0003393 | 75.27 | 3.99 |
| FLNA + CLDN7 + B3GNT9 + ARFGAP3 | 0.0003457 | 76.61 | 3.84 |
| GLYATL1 + FLNA + STRA13 + CLDN7 | 0.0003556 | 78.05 | 3.83 |
| FLNA + CLDN7 + ARFGAP3 | 0.0003764 | 75.08 | 3.96 |
| GLYATL1 + FLNA + CLDN7 + CNOT6 | 0.0003765 | 78.3 | 3.8 |
| FLNA + WHSC1 + CLDN7 + B3GNT9 | 0.000383 | 75.76 | 3.78 |
| OBSCN + FLNA + CLDN7 + ARFGAP3 | 0.0003918 | 75.76 | 3.94 |
| STRA13 + FAM83H + CLDN7 + B3GNT9 | 0.0004035 | 72.14 | 3.92 |
| OBSCN + FAM83H + CLDN7 + KDM2A | 0.0004132 | 70.89 | 3.91 |
| OBSCN + CLDN7 + KDM2A | 0.0004348 | 71.02 | 3.89 |
| OBSCN + CLDN7 + CNOT6 + KDM2A | 0.0004575 | 70.89 | 3.87 |
| GLYATL1 + CLDN7 + KDM2A + ARFGAP3 | 0.0004912 | 77.75 | 3.84 |
| GLYATL1 + STRA13 + CLDN7 + ARFGAP3 | 0.0004969 | 78.13 | 3.84 |
| WHSC1 + CLDN7 + KDM2A | 0.0004976 | 72.09 | 3.83 |
| WHSC1 + CLDN7 + CNOT6 + KDM2A | 0.0004976 | 72.19 | 3.89 |
| WHSC1 + CLDN7 + B3GNT9 | 0.0005185 | 74.89 | 3.83 |
| WHSC1 + CLDN7 + CNOT6 + B3GNT9 | 0.0005185 | 74.78 | 3.83 |
| FAM83H + CLDN7 + B3GNT9 | 0.00052 | 72.36 | 3.81 |
| OBSCN + FLNA | 0.000525 | 69.61 | 3.71 |
| STRA13 + CLDN7 + KDM2A | 0.0005255 | 70.7 | 3.81 |
| STRA13 + WHSC1 + CLDN7 + KDM2A | 0.0005546 | 72.39 | 3.79 |
| GLYATL1 + FLNA + CLDN7 + B3GNT9 | 0.0005799 | 79.22 | 3.54 |
| OBSCN + CLDN7 + CNOT6 + B3GNT9 | 0.0005827 | 72.88 | 3.77 |
| FLNA + STRA13 + CLDN7 + CNOT6 | 0.0005839 | 74.1 | 3.63 |
| FAM83H + CLDN7 + KDM2A | 0.0005959 | 70.56 | 3.76 |
| STRA13 + FAM83H + CLDN7 + KDM2A | 0.0005959 | 70.64 | 3.76 |
| FLNA + CLDN7 + CNOT6 | 0.0005991 | 74.07 | 3.61 |
| FLNA + CLDN7 + CNTO6 + KDM2A | 0.0005991 | 74.07 | 3.61 |
| OBSCN + STRA13 + CLDN7 + B3GNT9 | 0.0006117 | 72.63 | 3.75 |
| OBSCN + FLNA + CLDN7 + KDM2A | 0.0006671 | 74.21 | 3.57 |
| FLNA + WHSC1 | 0.0006777 | 69.93 | 3.58 |
| OBSCN + FLNA + WHSC1 | 0.0006777 | 69.85 | 3.58 |
| OBSCN + CLDN7 + B3GNT9 + KDM2A | 0.0006903 | 72.69 | 3.71 |
| OBSCN + WHSC1 + CLDN7 + B3GNT9 | 0.0006938 | 74.84 | 3.72 |
| GLYATL1 + WHSC1 + CLDN7 + B3GNT9 | 0.0007025 | 79.14 | 3.56 |
| FLNA + STRA13 + CLDN7 + B3GNT9 | 0.0007063 | 73.58 | 3.55 |
| FLNA + CLDN7 + CNTO6 + ARFGAP3 | 0.0007158 | 75.82 | 3.55 |
| CLDN7 + KDM2A + ARFGAP3 | 0.0007171 | 73.61 | 3.69 |
| OBSCN + CLDN7 + KDM2A + ARFGAP3 | 0.0007171 | 73.72 | 3.69 |
| OBSCN + FLNA + CLDN7 | 0.0007269 | 74.13 | 3.54 |
| OBSCN + FLNA + STRA13 + CLDN7 | 0.0007269 | 74.18 | 3.54 |
| OBSCN + FLNA + CLDN7 + CNOT6 | 0.0007269 | 74.46 | 3.54 |
| WHSC1 + CLDN7 | 0.000746 | 71.6 | 3.68 |
| WHSC1 + FAM83H + CLDN7 | 0.000746 | 71.16 | 3.68 |
| GLYATL1 + FLNA + CLDN7 + KDM2A | 0.000749 | 78.16 | 3.53 |
| STRA13 + FAM83H + CLDN7 | 0.0007541 | 71 | 3.52 |
| STRA13 + CLDN7 + ARFGAP3 | 0.0007541 | 74.21 | 3.67 |
| STRA13 + FAM83H + CLDN7 + ARFGAP3 | 0.0007541 | 74.07 | 3.67 |
| STRA13 + WHSC1 + CLDN7 + B3GNT9 | 0.0007576 | 75 | 3.68 |
| OBSCN + CLDN7 + B3GNT9 | 0.0007678 | 72.77 | 3.66 |
| OBSCN + FAM83H + CLDN7 + B3GNT9 | 0.0007678 | 73.15 | 3.66 |
| STRA13 + CLDN7 + B3GNT9 + KDM2A | 0.0007755 | 72.96 | 3.66 |
| WHSC1 + CLDN7 + B3GNT9 + ARFGAP3 | 0.0008265 | 76.06 | 3.49 |
| GLYATL1 + STRA13 + CNOT6 | 0.0008312 | 71.13 | 3.49 |
| GLYATL1 + STRA13 + CNOT6 + B3GNT9 | 0.0008312 | 71.35 | 3.49 |
| CLDN7 + CNOT6 + B3GNT9 | 0.00085 | 72.66 | 3.47 |
| FLNA + WHSC1 + B3GNT9 | 0.0008809 | 72.09 | 3.41 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| FLNA + STRA13 + WHSC1 + B3GNT9 | 0.0008809 | 72.03 | 3.41 |
| FLNA + WHSC1 + B3GNT9 + ARFGAP3 | 0.0008809 | 72.3 | 3.41 |
| FAM83H + WHSC1 + CLDN7 + KDM2A | 0.0008866 | 72.28 | 0.36 |
| GLYATL1 + FLNA + FAM83H + CLDN7 | 0.0008873 | 76.69 | 3.39 |
| CLDN7 + B3GNT9 + KDM2A | 0.0009393 | 72.82 | 3.59 |
| FAM83H + CLDN7 + B3GNT9 + KDM2A | 0.0009393 | 72.74 | 3.59 |
| CLDN7 + CNTO6 + B3GNT9 + KDM2A | 0.0009393 | 72.6 | 3.59 |
| GLYATL1 + WHSC1 + CLDN7 + KDM2A | 0.0009606 | 77.12 | 3.43 |
| GLYATL1 + CLDN7 + B3GNT9 + ARFGAP3 | 0.0009673 | 78.27 | 3.44 |
| OBSCN + FLNA + STRA13 + KDM2A | 0.001118 | 69.88 | 3.33 |
| GLYATL1 + STRA13 | 0.001122 | 70.94 | 3.38 |
| GLYATL1 + STRA13 + WHSC1 + B3GNT9 | 0.001125 | 71.38 | 3.37 |
| OBSCN + FLNA + CLDN7 + B3GNT9 | 0.001139 | 75.57 | 3.28 |
| FLNA + WHSC1 + CLDN7 | 0.001145 | 73.26 | 3.37 |
| GLYATL1 + STRA13 + CLDN7 + B3GNT9 | 0.001174 | 76.12 | 3.37 |
| GLYATL1 + FAM83H + CLDN7 + KDM2A | 0.001174 | 76.33 | 3.36 |
| OBSCN + WHSC1 + CLDN7 + KDM2A | 0.00118 | 72.03 | 3.35 |
| FAM83H + CLDN7 + CNOT6 + B3GNT9 | 0.00121 | 72.69 | 3.35 |
| GLYATL1 + WHSC1 + KDM2A + ARFGAP4 | 0.001232 | 70.07 | 3.34 |
| OBSCN + FLNA + STRA13 | 0.001234 | 69.64 | 3.28 |
| STRA13 + CLDN7 + CNOT6 | 0.001276 | 72.11 | 3.33 |
| STRA13 + WHSC1 + CNOT6 + KDM2A | 0.001292 | 65.66 | 3.33 |
| FLNA + FAM83H + WHSC1 + B3GNT9 | 0.001304 | 72.52 | 3.24 |
| FLNA + CLDN7 + CNTO6 + B3GNT9 | 0.00131 | 75.19 | 3.22 |
| GLYATL1 + FLNA + WHSC1 + CLDN7 | 0.001332 | 77.7 | 3.23 |
| OBSCN + FLNA + FAM83H + ARFGAP3 | 0.001342 | 70.32 | 3.24 |
| OBSCN + FLNA + FAM83H + CNOT6 | 0.001369 | 69.34 | 3.27 |
| FLNA + CLDN7 + B3GNT9 | 0.001386 | 73.91 | 3.22 |
| FLNA + FAM83H + CLDN7 + B3GNT9 | 0.001386 | 73.88 | 3.22 |
| GLYATL1 + WHSC1 + CLDN7 + ARFGAP3 | 0.001486 | 77.72 | 3.27 |
| GLYATL1 + FAM83H + CLDN7 + ARFGAP3 | 0.001519 | 76.99 | 3.27 |
| GLYATL1 + FLNA + CLDN7 | 0.001524 | 77.7 | 3.18 |
| GLYATL1 + OBSCN + FLNA + CLDN7 | 0.001524 | 77.64 | 3.18 |
| FLNA + STRA13 + CNOT6 | 0.001535 | 69.25 | 3.2 |
| OBSCN + FLNA + STRA13 + CNOT6 | 0.001535 | 69.58 | 3.2 |
| FLNA + WHSC1 + CLDN7 + KDM2A | 0.001565 | 73.86 | 3.25 |
| OBSCN + FLNA + STRA13 + FAM83H | 0.001592 | 69.8 | 3.18 |
| OBSCN + STRA13 + FAM83H + CLDN7 | 0.001601 | 71.95 | 3.25 |
| FLNA + STRA13 + WHSC1 + KDM2A | 0.00161 | 69.91 | 3.18 |
| FLNA + FAM83H + WHSC1 + CNOT6 | 0.001612 | 69.53 | 3.18 |
| GLYATL1 + WHSC1 + B3GNT9 + KDM2A | 0.00164 | 71.54 | 3.23 |
| GLYATL1 + FLNA + CLDN7 + ARFGAP3 | 0.00167 | 78.81 | 3.14 |
| OBSCN + FLNA + CNOT6 | 0.001694 | 69.61 | 3.16 |
| FAM83H + WHSC1 + CLDN7 + B3GNT9 | 0.001698 | 75.05 | 3.24 |
| GLYATL1 + STRA13 + WHSC1 + CLDN7 | 0.001703 | 76.55 | 3.14 |
| OBSCN + FAM83H + WHSC1 + CLDN7 | 0.001728 | 71.38 | 3.22 |
| GLYATL1 + CLDN7 + ARFGAP3 | 0.00174 | 77.26 | 3.22 |
| FLNA + WHSC1 + CLDN7 + CNTO6 | 0.001749 | 74.26 | 3.12 |
| STRA13 + FAM83H + WHSC1 + CLDN7 | 0.001765 | 71.68 | 3.21 |
| FLNA + STRA13 + WHSC1 + CLDN7 | 0.001793 | 73.47 | 3.12 |
| OBSCN + FLNA + FAM83H + CLDN7 | 0.001799 | 74.62 | 3.12 |
| CLDN7 + CNOT6 + KDM2A | 0.001801 | 70.83 | 3.2 |
| STRA13 + CLDN7 + CNOT6 + KDM2A | 0.001801 | 70.75 | 3.2 |
| GLYATL1 + STRA13 + CNOT6 + ARFGAP3 | 0.001819 | 73.09 | 3.2 |
| FLNA + WHSC1 + KDM2A | 0.001842 | 69.66 | 3.12 |
| OBSCN + CLDN7 + CNOT6 | 0.001874 | 71.79 | 3.19 |
| OBSCN + FAM83H + CLDN7 + CNOT6 | 0.001874 | 71.8 | 3.19 |
| GLYATL1 + FAM83H + WHSC1 + CLDN7 | 0.001895 | 76.14 | 3.1 |
| OBSCN + FLNA + FAM83H | 0.001912 | 69.01 | 3.11 |
| STRA13 + WHSC1 + CLDN7 | 0.001934 | 72.09 | 3.19 |
| OBSCN + STRA13 + WHSC1 + CLDN7 | 0.001934 | 72.52 | 3.19 |
| GLYATL1 + OBSCN + CLDN7 + KDM2A | 0.001983 | 76.39 | 3.17 |
| GLYATL1 + CLDN7 + CNOT6 + KDM2A | 0.001983 | 76.47 | 3.17 |
| FLNA + CLDN7 + B3GNT9 + KDM2A | 0.001997 | 74.89 | 3.08 |
| OBSCN + FLNA + WHSC1 + KDM2A | 0.002003 | 69.58 | 3.09 |
| OBSCN + STRA13 + CLDN7 | 0.002011 | 72.03 | 3.17 |
| GLYATL1 + CLDN7 + CNOT6 + B3GNT9 | 0.002045 | 76.39 | 3.08 |
| GLYATL1 + CLDN7 + CNOT6 + ARFGAP3 | 0.002051 | 77.15 | 3.16 |
| WHSC1 + CLDN7 + CNOT6 | 0.002116 | 72.28 | 3.15 |
| OBSCN + WHSC1 + CLDN7 + CNOT6 | 0.002116 | 72.39 | 3.15 |
| GLYATL1 + CLDN7 + KDM2A | 0.002139 | 76.63 | 3.14 |
| GLYATL1 + STRA13 + CLDN7 + KDM2A | 0.002139 | 76.82 | 3.14 |
| OBSCN + FLNA + FAM83H + KDM2A | 0.0022 | 69.25 | 3.06 |
| FLNA + CLDN7 + KDM2A | 0.002315 | 73.75 | 3.03 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| FLNA + STRA13 + CLDN7 + KDM2A | 0.002315 | 73.83 | 3.03 |
| FLNA + FAM83H + CLDN7 + KDM2A | 0.002315 | 73.64 | 3.03 |
| FLNA + STRA13 | 0.002333 | 69.47 | 3.06 |
| FLNA + WHSC1 + B3GNT9 + KDM2A | 0.002354 | 71.9 | 3 |
| FLNA + FAM83H + KDM2A | 0.002355 | 68.38 | 3.05 |
| FLNA + WHSC1 + CNOT6 | 0.00236 | 69.69 | 3.03 |
| OBSCN + FLNA + WHSC1 + CNOT6 | 0.00236 | 69.61 | 3.03 |
| STRA13 + CLDN7 + KDM2A + ARFGAP3 | 0.002362 | 73.86 | 3.11 |
| OBSCN + FLNA + WHSC1 + CLDN7 | 0.002368 | 73.64 | 3.02 |
| GLYATL1 + STRA13 + WHSC1 + KDM2A | 0.002384 | 69.99 | 3.1 |
| FLNA + FAM83H | 0.002494 | 68.19 | 3.03 |
| GLYATL1 + FAM83H + CLDN7 + B3GNT9 | 0.002507 | 76.06 | 3.01 |
| FLNA | 0.002583 | 68.36 | 3.02 |
| FLNA + KDM2A | 0.002583 | 68.33 | 3.02 |
| FLNA + CNTO6 + B3GNT9 | 0.002597 | 70.29 | 3 |
| FLNA + CNTO6 + B3GNT9 + KDM2A | 0.002597 | 70.34 | 3 |
| GLYATL1 + OBSCN + WHSC1 + CLDN7 | 0.002632 | 76.42 | 2.98 |
| GLYATL1 + STRA13 + FAM83H + CNOT6 | 0.00289 | 70.97 | 2.95 |
| GLYATL1 + FAM83H + WHSC1 + B3GNT9 | 0.002944 | 70.86 | 2.95 |
| GLYATL1 + STRA13 + CLDN7 | 0.002996 | 75.87 | 2.95 |
| OBSCN + FAM83H + CLDN7 | 0.003002 | 71.6 | 3.03 |
| FLNA + STRA13 + CLDN7 | 0.00304 | 72.6 | 2.93 |
| GLYATL1 + FAM83H + B3GNT9 + ARFGAP3 | 0.003067 | 68.87 | 2.93 |
| FAM83H + CLDN7 + KDM2A + ARFGAP3 | 0.003085 | 73.37 | 3.01 |
| FLNA + FAM83H + ARFGAP3 | 0.003087 | 69.69 | 2.91 |
| FLNA + STRA13 + KDM2A | 0.003129 | 69.5 | 2.94 |
| GLYATL1 + CLDN7 + B3GNT9 | 0.003239 | 75.41 | 2.93 |
| OBSCN + FLNA + KDM2A | 0.003286 | 69.53 | 2.89 |
| GLYATL1 + STRA13 + FAM83H + ARFGAP3 | 0.0033 | 71.54 | 2.91 |
| GLYATL1 + OBSCN + STRA13 + ARFGAP3 | 0.003302 | 71.49 | 2.91 |
| STRA13 + FAM83H + CLDN7 + CNOT6 | 0.003325 | 71.9 | 2.9 |
| GLYATL1 + CNOT6 + ARFGAP3 | 0.003426 | 69.14 | 2.9 |
| GLYATL1 + OBSCN + WHSC1 + KDM2A | 0.003501 | 69.99 | 2.88 |
| FLNA + WHSC1 + ARFGAP3 | 0.00351 | 70.62 | 2.84 |
| GLYATL1 + OBSCN + CLDN7 + B3GNT9 | 0.003561 | 76.44 | 2.89 |
| STRA13 + CLDN7 + CNOT6 + B3GNT9 | 0.003567 | 72.52 | 2.88 |
| GLYATL1 + B3GNT9 + ARFGAP3 | 0.0036 | 68.79 | 2.88 |
| GLYATL1 + WHSC1 + B3GNT9 | 0.003623 | 70.78 | 2.87 |
| GLYATL1 + STRA13 + FAM83H | 0.003748 | 70.75 | 2.86 |
| GLYATL1 + STRA13 + B3GNT9 | 0.003748 | 71.08 | 2.86 |
| GLYATL1 + STRA13 + FAM83H + B3GNT9 | 0.003748 | 70.92 | 2.86 |
| FLNA + B3GNT9 + KDM2A | 0.003789 | 70.23 | 2.84 |
| FLNA + STRA13 + B3GNT9 + KDM2A | 0.003789 | 70.26 | 2.84 |
| FLNA + FAM83H + CNOT6 + ARFGAP3 | 0.003858 | 69.66 | 2.84 |
| GLYATL1 + FLNA + FAM83H + CNOT6 | 0.003889 | 70.53 | 2.84 |
| FLNA + STRA13 + WHSC1 + ARFGAP3 | 0.003947 | 70.56 | 2.81 |
| FAM83H + CLDN7 + CNOT6 | 0.00395 | 71.7 | 2.85 |
| FLNA + ARFGAP3 | 0.004 | 69.99 | 2.82 |
| GLYATL1 + WHSC1 + CNOT9 + B3GNT9 | 0.004007 | 70.7 | 2.84 |
| WHSC1 + CNOT6 + B3GNT9 + KDM2A | 0.004007 | 67.51 | 2.84 |
| OBSCN + FLNA + WHSC1 + ARFGAP3 | 0.004039 | 70.59 | 2.8 |
| FLNA + WHSC1 + CNTO6 + B3GNT9 | 0.004051 | 71.79 | 2.8 |
| GLYATL1 + OBSCN + STRA13 + B3GNT9 | 0.004118 | 70.67 | 2.83 |
| FLNA + CLDN7 | 0.004151 | 72.3 | 2.83 |
| GLYATL1 + FAM83H + CLDN7 | 0.004167 | 74.37 | 2.83 |
| OBSCN + FLNA + ARFGAP3 | 0.004294 | 69.99 | 2.79 |
| OBSCN + FLNA + CNOT6 + ARFGAP3 | 0.004294 | 69.99 | 2.79 |
| FLNA + FAM83H + CNOT6 + B3GNT9 | 0.004329 | 69.91 | 2.81 |
| CLDN7 + CNOT6 | 0.004405 | 71.73 | 2.81 |
| FLNA + FAM83H + KDM2A + ARFGAP3 | 0.004462 | 69.69 | 2.77 |
| STRA13 + WHSC1 + CLDN7 + CNOT6 | 0.004517 | 72.6 | 2.8 |
| FLNA + STRA13 + FAM83H + CNOT6 | 0.004554 | 69.74 | 2.77 |
| GLYATL1 + WHSC1 + CNOT9 + KDM2A | 0.004635 | 68.57 | 2.79 |
| GLYATL1 + ARFGAP3 | 0.004637 | 68.3 | 2.79 |
| GLYATL1 + OBSCN + ARFGAP3 | 0.004637 | 68.55 | 2.79 |
| GLYATL1 + FAM83H + ARFGAP3 | 0.004637 | 68.27 | 2.79 |
| FLNA + STRA13 + KDM2A + ARFGAP3 | 0.004676 | 70.62 | 2.75 |
| FLNA + STRA13 + WHSC1 | 0.004682 | 69.8 | 2.74 |
| FLNA + STRA13 + WHSC1 + CNOT6 | 0.004682 | 69.83 | 2.74 |
| FLNA + FAM83H + CNOT6 | 0.004758 | 68.71 | 2.76 |
| FLNA + STRA13 + FAM83H + ARFGAP3 | 0.004777 | 70.18 | 2.75 |
| GLYATL1 + STRA13 + ARFGAP3 | 0.004809 | 70.78 | 2.78 |
| GLYATL1 + STRA13 + B3GNT9 + ARFGAP3 | 0.004809 | 70.86 | 2.78 |
| GLYATL1 + OBSCN + KDM2A + ARFGAP4 | 0.004844 | 67.89 | 2.78 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| OBSCN + STRA13 + CLDN7 + CNOT6 | 0.004934 | 72 | 2.77 |
| GLYATL1 + FLNA + WHSC1 + B3GNT9 | 0.005072 | 74.4 | 2.73 |
| FAM83H + CLDN7 + CNOT6 + KDM2A | 0.005089 | 70.78 | 2.76 |
| OBSCN + FLNA + STRA13 + WHSC1 | 0.005122 | 69.72 | 2.72 |
| GLYATL1 + WHSC1 + ARFGAP3 | 0.005143 | 69.91 | 2.76 |
| FLNA + FAM83H + CNOT6 + KDM2A | 0.005143 | 68.63 | 2.74 |
| FLNA + WHSC1 + CNTO6 + KDM2A | 0.005296 | 69.74 | 2.71 |
| GLYATL1 + FLNA + STRA13 + B3GNT9 | 0.00532 | 74.02 | 2.72 |
| FLNA + STRA13 + ARFGAP3 | 0.005331 | 70.67 | 2.71 |
| OBSCN + FLNA + STRA13 + ARFGAP3 | 0.005331 | 70.67 | 2.71 |
| GLYATL1 + OBSCN + FAM83H + ARFGAP3 | 0.005425 | 68.55 | 2.74 |
| GLYATL1 + OBSCN + CLDN7 + ARFGAP3 | 0.005507 | 77.21 | 2.74 |
| FLNA + STRA13 + FAM83H + WHSC1 | 0.005669 | 70.45 | 2.69 |
| GLYATL1 + B3GNT9 + KDM2A | 0.005809 | 68.11 | 2.72 |
| FLNA + CNOT6 | 0.005816 | 69.01 | 2.69 |
| GLYATL1 + OBSCN + B3GNT9 + KDM2A | 0.005937 | 68.16 | 2.72 |
| GLYATL1 + B3GNT9 + KDM2A + ARFGAP3 | 0.00597 | 69.13 | 2.71 |
| OBSCN + FLNA + FAM83H + WHSC1 | 0.006015 | 69.09 | 2.66 |
| OBSCN + WHSC1 + CLDN7 | 0.006231 | 71.7 | 2.7 |
| GLYATL1 + STRA13 + FAM83H + WHSC1 | 0.006322 | 71.21 | 2.64 |
| FLNA + CNTO6 + KDM2A | 0.006354 | 68.95 | 2.66 |
| GLYATL1 + OBSCN + STRA13 + CLDN7 | 0.006421 | 76.06 | 2.64 |
| GLYATL1 + WHSC1 + CLDN7 | 0.006612 | 76.63 | 2.62 |
| GLYATL1 + OBSCN + STRA13 + CNOT6 | 0.00671 | 70.32 | 2.62 |
| OBSCN + CLDN7 | 0.006813 | 71.19 | 2.67 |
| FLNA + STRA13 + FAM83H | 0.007044 | 69.42 | 2.62 |
| FLNA + STRA13 + FAM83H + KDM2A | 0.007044 | 69.42 | 2.62 |
| FLNA + B3GNT9 | 0.007048 | 69.99 | 2.62 |
| FLNA + FAM83H + WHSC1 + ARFGAP3 | 0.007075 | 70.59 | 2.61 |
| GLYATL1 + STRA13 + WHSC1 + CNOT6 | 0.007085 | 71.35 | 2.6 |
| OBSCN + WHSC1 + KDM2A | 0.007177 | 64.71 | 2.65 |
| OBSCN + WHSC1 + CNOT6 + KDM2A | 0.007589 | 65.36 | 2.63 |
| GLYATL1 + WHSC1 + CLDN7 + CNOT6 | 0.007696 | 76.5 | 2.58 |
| STRA13 + CNOT6 + ARFGAP3 | 0.007809 | 67.13 | 2.62 |
| FLNA + STRA13 + B3GNT9 | 0.007872 | 69.93 | 2.56 |
| FLNA + STRA13 + CNOT6 + B3GNT9 | 0.007872 | 70.32 | 2.56 |
| OBSCN + FLNA + B3GNT9 | 0.008032 | 70.64 | 2.56 |
| OBSCN + FLNA + STRA13 + B3GNT9 | 0.008032 | 70.72 | 2.56 |
| OBSCN + FLNA + CNOT6 + B3GNT9 | 0.008032 | 70.59 | 2.56 |
| OBSCN + FLNA + B3GNT9 + KDM2A | 0.008032 | 70.75 | 2.56 |
| FLNA + STRA13 + FAM83H + CLDN7 | 0.008161 | 72.77 | 2.56 |
| GLYATL1 + STRA13 + FAM83H + CLDN7 | 0.008374 | 76.03 | 2.56 |
| GLYATL1 + FAM83H + CLDN7 + CNOT6 | 0.008471 | 75.16 | 2.55 |
| FLNA + FAM83H + CLDN7 | 0.008498 | 72.47 | 2.54 |
| GLYATL1 + FLNA + STRA13 | 0.00852 | 72.36 | 2.52 |
| GLYATL1 + FLNA + STRA13 + WHSC1 | 0.00852 | 72.41 | 2.52 |
| GLYATL1 + FAM83H + WHSC1 + KDM2A | 0.008571 | 69.77 | 2.54 |
| GLYATL1 + CLDN7 + CNOT6 | 0.008593 | 75.3 | 2.54 |
| GLYATL1 + CNOT6 + B3GNT9 + ARFGAP3 | 0.008642 | 68.79 | 2.55 |
| GLYATL1 + STRA13 + WHSC1 | 0.008678 | 70.81 | 2.53 |
| OBSCN + FLNA + CNOT6 + KDM2A | 0.008703 | 69.14 | 2.53 |
| GLYATL1 + FLNA + STRA13 + CNOT6 | 0.008814 | 72.19 | 2.51 |
| GLYATL1 + FLNA + STRA13 + ARFGAP3 | 0.008814 | 72.39 | 2.51 |
| GLYATL1 + OBSCN + STRA13 + WHSC1 | 0.008911 | 71.87 | 2.53 |
| FLNA + CNTO6 + ARFGAP3 | 0.008929 | 69.91 | 2.53 |
| OBSCN + STRA13 + KDM2A + ARFGAP3 | 0.008982 | 66.01 | 2.58 |
| FAM83H + WHSC1 + B3GNT9 + KDM2A | 0.009096 | 67.51 | 2.53 |
| GLYATL1 + FLNA + STRA13 + FAM83H | 0.009178 | 71.35 | 2.51 |
| FLNA + WHSC1 + CNTO6 + ARFGAP3 | 0.009708 | 70.53 | 2.48 |
| OBSCN + ARFGAP3 | 0.009716 | 63.37 | 2.55 |
| OBSCN + STRA13 + CNOT6 + B3GNT9 | 0.009851 | 64.13 | 2.5 |
| OBSCN + FAM83H + ARFGAP3 | 0.009929 | 63.53 | 2.54 |
| STRA13 + FAM83H + WHSC1 + ARFGAP3 | 0.01006 | 66.45 | 2.49 |
| FLNA + WHSC1 + KDM2A + ARFGAP3 | 0.01017 | 70.72 | 2.47 |
| OBSCN + STRA13 + WHSC1 + CNOT6 | 0.01018 | 64.9 | 2.49 |
| OBSCN + STRA13 + FAM83H + B3GNT9 | 0.01056 | 64.3 | 2.48 |
| FLNA + STRA13 + FAM83H + B3GNT9 | 0.01062 | 69.83 | 2.47 |
| OBSCN + FLNA + KDM2A + ARFGAP3 | 0.01066 | 70.45 | 2.45 |
| GLYATL1 + FLNA + FAM83H + B3GNT9 | 0.01088 | 73.01 | 2.45 |
| GLYATL1 + OBSCN + B3GNT9 + ARFGAP3 | 0.01114 | 69.14 | 2.46 |
| GLYATL1 + OBSCN + FLNA + STRA13 | 0.01132 | 72.3 | 2.44 |
| OBSCN + FLNA + FAM83H + B3GNT9 | 0.01132 | 70.04 | 2.44 |
| GLYATL1 + FAM83H + WHSC1 + ARFGAP3 | 0.01152 | 69.88 | 2.45 |
| FLNA + STRA13 + CNOT6 + ARFGAP3 | 0.01155 | 70.59 | 2.43 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| GLYATL1 + WHSC1 + B3GNT9 + ARFGAP3 | 0.0117 | 71.08 | 2.44 |
| GLYATL1 + OBSCN + CNOT6 + ARFGAP3 | 0.01186 | 68.85 | 2.44 |
| FLNA + STRA13 + CNOT6 + KDM2A | 0.0122 | 69.44 | 2.41 |
| FAM83H + WHSC1 + CLDN7 + CNOT6 | 0.01239 | 71.98 | 2.43 |
| GLYATL1 + OBSCN + STRA13 + FAM83H | 0.01245 | 70.37 | 2.42 |
| GLYATL1 + OBSCN + B3GNT9 | 0.0126 | 67.02 | 2.42 |
| GLYATL1 + OBSCN + WHSC1 + CNOT6 | 0.01271 | 68.98 | 2.42 |
| GLYATL1 + FLNA + FAM83H + KDM2A | 0.0129 | 69.83 | 2.39 |
| STRA13 + CNOT6 + KDM2A + ARFGAP3 | 0.01293 | 66.09 | 2.42 |
| GLYATL1 + STRA13 + FAM83H + KDM2A | 0.01304 | 66.39 | 2.41 |
| GLYATL1 + OBSCN + WHSC1 + B3GNT9 | 0.01323 | 71.35 | 2.4 |
| OBSCN + STRA13 + WHSC1 + KDM2A | 0.01323 | 64.68 | 2.41 |
| FLNA + CNTO6 + KDM2A + ARFGAP3 | 0.01323 | 70.07 | 2.39 |
| GLYATL1 + OBSCN + STRA13 | 0.01332 | 70.18 | 2.4 |
| FLNA + KDM2A + ARFGAP3 | 0.0136 | 70.04 | 2.38 |
| GLYATL1 + OBSCN + WHSC1 | 0.01361 | 69.2 | 2.39 |
| GLYATL1 + WHSC1 + KDM2A | 0.01362 | 68.95 | 2.39 |
| GLYATL1 + OBSCN + CNOT6 + B3GNT9 | 0.01365 | 66.91 | 2.4 |
| GLYATL1 + CNOT6 + KDM2A | 0.01366 | 64.49 | 2.4 |
| GLYATL1 + OBSCN + CNOT6 + KDM2A | 0.01366 | 64.49 | 2.4 |
| STRA13 + CLDN7 + B3GNT9 | 0.01397 | 70.67 | 2.39 |
| GLYATL1 + OBSCN + KDM2A | 0.0141 | 64.43 | 2.39 |
| GLYATL1 + STRA13 + WHSC1 + ARFGAP3 | 0.01414 | 70.67 | 2.38 |
| GLYATL1 + CNOT6 + B3GNT9 + KDM2A | 0.01475 | 67.57 | 2.37 |
| GLYATL1 + KDM2A + ARFGAP3 | 0.01502 | 67.54 | 2.37 |
| FLNA + FAM83H + WHSC1 | 0.01509 | 69.25 | 2.34 |
| FLNA + FAM83H + WHSC1 + KDM2A | 0.01509 | 69.14 | 2.34 |
| GLYATL1 + FLNA + B3GNT9 + KDM2A | 0.01511 | 73.5 | 2.36 |
| GLYATL1 + STRA13 + B3GNT9 + KDM2A | 0.01534 | 68.71 | 2.36 |
| FAM83H + WHSC1 + KDM2A + ARFGAP3 | 0.01573 | 65.93 | 2.35 |
| GLYATL1 + FLNA + B3GNT9 | 0.01576 | 73.91 | 2.35 |
| GLYATL1 + OBSCN + FLNA + B3GNT9 | 0.01586 | 73.18 | 2.35 |
| GLYATL1 + FLNA + B3GNT9 + ARFGAP3 | 0.01627 | 73.42 | 2.34 |
| STRA13 + CLDN7 | 0.01664 | 69.47 | 2.34 |
| OBSCN + WHSC1 + B3GNT9 + KDM2A | 0.01722 | 67.05 | 2.3 |
| GLYATL1 + FAM83H + B3GNT9 | 0.01744 | 67.95 | 2.32 |
| GLYATL1 + OBSCN + FAM83H + B3GNT9 | 0.01744 | 67.4 | 2.32 |
| GLYATL1 + FLNA + FAM83H + ARFGAP3 | 0.01747 | 70.59 | 2.3 |
| OBSCN + CNOT6 + B3GNT9 + KDM2A | 0.01757 | 63.21 | 2.32 |
| STRA13 + B3GNT9 + KDM2A | 0.01798 | 63.4 | 2.31 |
| GLYATL1 + FAM83H + CNOT6 + ARFGAP3 | 0.01802 | 69.83 | 2.31 |
| OBSCN + STRA13 + B3GNT9 + KDM2A | 0.01865 | 63.37 | 2.3 |
| WHSC1 + CNOT6 + KDM2A | 0.01933 | 65.09 | 2.29 |
| GLYATL1 + FAM83H + B3GNT9 + KDM2A | 0.01971 | 66.48 | 2.28 |
| CLDN7 + B3GNT9 | 0.01988 | 69.01 | 2.28 |
| GLYATL1 + STRA13 + KDM2A + ARFGAP3 | 0.02048 | 69.96 | 2.27 |
| FAM83H + CNOT6 + B3GNT9 + KDM2A | 0.02064 | 62.66 | 2.25 |
| FLNA + FAM83H + B3GNT9 | 0.02072 | 69.42 | 2.26 |
| GLYATL1 + FLNA + CNOT6 + B3GNT9 | 0.02132 | 73.39 | 2.23 |
| GLYATL1 + STRA13 + CLDN7 + CNOT6 | 0.02179 | 76.03 | 2.23 |
| FLNA + B3GNT9 + ARFGAP3 | 0.02261 | 71.05 | 2.21 |
| OBSCN + FLNA + B3GNT9 + ARFGAP3 | 0.02261 | 71.32 | 2.21 |
| GLYATL1 + FLNA + KDM2A + ARFGAP3 | 0.02317 | 71.49 | 2.2 |
| FLNA + CNTO6 + B3GNT9 + ARFGAP3 | 0.02348 | 71.24 | 2.2 |
| FLNA + B3GNT9 + KDM2A + ARFGAP3 | 0.02348 | 71.05 | 2.2 |
| GLYATL1 + FLNA + WHSC1 + KDM2A | 0.02359 | 71.6 | 2.19 |
| STRA13 + FAM83H + KDM2A + ARFGAP3 | 0.02368 | 65.8 | 2.23 |
| FLNA + FAM83H + B3GNT9 + KDM2A | 0.02373 | 69.39 | 2.2 |
| GLYATL1 + FLNA + STRA13 + KDM2A | 0.02381 | 72.55 | 2.19 |
| STRA13 + KDM2A + ARFGAP3 | 0.02396 | 65.85 | 2.22 |
| OBSCN + STRA13 + B3GNT9 | 0.02399 | 64.27 | 2.2 |
| OBSCN + CNOT6 + ARFGAP3 | 0.02409 | 64.16 | 2.22 |
| KDM2A + ARFGAP3 | 0.0242 | 63.86 | 2.22 |
| GLYATL1 + OBSCN + STRA13 + KDM2A | 0.02424 | 67.62 | 2.19 |
| GLYATL1 + CNOT6 + KDM2A + ARFGAP3 | 0.02495 | 67.18 | 2.18 |
| OBSCN + KDM2A + ARFGAP3 | 0.02554 | 63.59 | 2.21 |
| OBSCN + FLNA + WHSC1 + B3GNT9 | 0.0258 | 71.38 | 2.16 |
| OBSCN + STRA13 | 0.02636 | 63.83 | 2.17 |
| GLYATL1 + FLNA + CNOT6 + KDM2A | 0.02693 | 71.41 | 2.15 |
| STRA13 + WHSC1 + B3GNT9 + ARFGAP3 | 0.02709 | 67.67 | 2.16 |
| CNTO6 + ARFGAP3 | 0.02717 | 63.34 | 2.19 |
| OBSCN + STRA13 + FAM83H + CNOT6 | 0.02733 | 63.81 | 2.16 |
| STRA13 + FAM83H + WHSC1 + KDM2A | 0.02739 | 65.55 | 2.16 |
| WHSC1 + B3GNT9 + KDM2A + ARFGAP3 | 0.0275 | 67.37 | 2.15 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| ARFGAP3 | 0.02764 | 63.34 | 2.18 |
| STRA13 + WHSC1 + CNOT6 | 0.02765 | 65.09 | 2.15 |
| GLYATL1 + FLNA | 0.0278 | 71.54 | 2.14 |
| GLYATL1 + FLNA + WHSC1 | 0.0278 | 71.62 | 2.14 |
| GLYATL1 + FLNA + CNOT6 | 0.0278 | 71.19 | 2.14 |
| GLYATL1 + FLNA + ARFGAP3 | 0.0278 | 71.41 | 2.14 |
| GLYATL1 + FLNA + WHSC1 + ARFGAP3 | 0.0278 | 71.35 | 2.14 |
| GLYATL1 + FLNA + CNOT6 + ARFGAP3 | 0.0278 | 71.27 | 2.14 |
| FLNA + FAM83H + B3GNT9 + ARFGAP3 | 0.02795 | 71.38 | 2.14 |
| B3GNT9 + ARFGAP3 | 0.02874 | 62.85 | 2.17 |
| GLYATL1 + FLNA + KDM2A | 0.02879 | 71.41 | 2.13 |
| OBSCN + CNOT6 + B3GNT9 + ARFGAP3 | 0.02909 | 64.27 | 2.16 |
| GLYATL1 + OBSCN + FAM83H + WHSC1 | 0.02911 | 69.17 | 2.13 |
| GLYATL1 + OBSCN + FAM83H + CNOT6 | 0.02917 | 65.8 | 2.14 |
| B3GNT9 + KDM2A | 0.03016 | 62.85 | 2.13 |
| GLYATL1 + WHSC1 | 0.03048 | 69.04 | 2.12 |
| GLYATL1 + WHSC1 + CNOT6 | 0.03097 | 68.65 | 2.12 |
| GLYATL1 + FAM83H + KDM2A + ARFGAP3 | 0.03139 | 66.34 | 2.11 |
| GLYATL1 + OBSCN + FLNA | 0.03183 | 71.27 | 2.1 |
| GLYATL1 + OBSCN + FLNA + CNOT6 | 0.03183 | 71.38 | 2.1 |
| GLYATL1 + OBSCN + FLNA + KDM2A | 0.03183 | 71.32 | 2.1 |
| GLYATL1 + OBSCN + FLNA + ARFGAP3 | 0.03183 | 71.46 | 2.1 |
| GLYATL1 + OBSCN + FAM83H | 0.0326 | 66.04 | 2.1 |
| GLYATL1 + STRA13 + CNOT6 + KDM2A | 0.0331 | 66.75 | 2.1 |
| WHSC1 + FAM83H + KDM2A | 0.03356 | 64.38 | 2.09 |
| GLYATL1 + KDM2A | 0.03432 | 65.03 | 2.09 |
| GLYATL1 + OBSCN + FLNA + WHSC1 | 0.03629 | 71.51 | 2.06 |
| GLYATL1 | 0.03653 | 64.62 | 2.07 |
| WHSC1 + FAM83H + ARFGAP3 | 0.03707 | 64.87 | 2.06 |
| OBSCN + FAM83H + WHSC1 + KDM2A | 0.03717 | 64.3 | 2.06 |
| FAM83H + WHSC1 + CNOT6 + ARFGAP3 | 0.03774 | 64.92 | 2.06 |
| OBSCN + STRA13 + CNOT6 + ARFGAP3 | 0.0387 | 67.05 | 2.05 |
| GLYATL1 + FLNA + FAM83H | 0.03911 | 69.55 | 2.04 |
| GLYATL1 + B3GNT9 | 0.03935 | 66.86 | 2.05 |
| STRA13 + FAM83H + B3GNT9 + KDM2A | 0.03974 | 63.07 | 2.05 |
| GLYATL1 + STRA13 + KDM2A | 0.04003 | 67.43 | 2.04 |
| OBSCN + FAM83H + WHSC1 + ARFGAP3 | 0.0402 | 64.84 | 2.04 |
| GLYATL1 + OBSCN + WHSC1 + ARFGAP3 | 0.04023 | 71.43 | 2.04 |
| STRA13 + WHSC1 + KDM2A | 0.04041 | 64.24 | 2.04 |
| FAM83H + WHSC1 + CNOT6 + KDM2A | 0.04072 | 64.71 | 2.04 |
| GLYATL1 + FLNA + FAM83H + WHSC1 | 0.04123 | 69.85 | 2.02 |
| OBSCN + B3GNT9 + KDM2A + ARFGAP3 | 0.04183 | 65.06 | 2.03 |
| FAM83H + B3GNT9 + KDM2A + ARFGAP3 | 0.04198 | 64.6 | 2.03 |
| OBSCN + B3GNT9 + ARFGAP3 | 0.04203 | 63.02 | 2.03 |
| OBSCN + FAM83H + B3GNT9 + ARFGAP3 | 0.04203 | 63.18 | 2.03 |
| STRA13 + FAM83H + WHSC1 + CNOT6 | 0.0424 | 65.28 | 2.02 |
| GLYATL1 + WHSC1 + CNOT9 + ARFGAP3 | 0.04324 | 70.64 | 2.02 |
| STRA13 + CNOT6 + B3GNT9 + ARFGAP3 | 0.04421 | 67.02 | 2.01 |
| GLYATL1 + FAM83H + CNOT6 + B3GNT9 | 0.04538 | 68.36 | 2 |
| FLNA + FAM83H + WHSC1 + CLDN7 | 0.046 | 72.71 | 2.8 |
| FAM83H + KDM2A + ARFGAP3 | 0.04825 | 62.66 | 1.99 |
| OBSCN + FAM83H + KDM2A + ARFGAP3 | 0.04825 | 62.77 | 1.99 |
| CNOT6 + B3GNT9 + ARFGAP3 | 0.05115 | 62.91 | 1.97 |
| OBSCN + STRA13 + CNOT6 | 0.05257 | 63.51 | 1.95 |
| STRA13 + B3GNT9 + KDM2A + ARFGAP3 | 0.05265 | 66.48 | 1.96 |
| OBSCN + STRA13 + ARFGAP3 | 0.05312 | 66.48 | 1.96 |
| FAM83H + CNOT6 + B3GNT9 + ARFGAP3 | 0.05353 | 63.78 | 1.96 |
| FAM83H + B3GNT9 + ARFGAP3 | 0.05477 | 63.32 | 1.95 |
| FAM83H + WHSC1 + B3GNT9 + ARFGAP3 | 0.05645 | 66.09 | 1.93 |
| STRA13 + FAM83H + WHSC1 | 0.0569 | 64.6 | 1.93 |
| OBSCN + STRA13 + FAM83H + WHSC1 | 0.0569 | 64.92 | 1.93 |
| GLYATL1 + FLNA + WHSC1 + CNOT6 | 0.05696 | 71.19 | 1.92 |
| FLNA + STRA13 + B3GNT9 + ARFGAP3 | 0.05783 | 71 | 1.92 |
| WHSC1 + KDM2A | 0.05887 | 64.3 | 1.93 |
| GLYATL1 + CLDN7 | 0.05904 | 73.86 | 1.91 |
| B3GNT9 + KDM2A + ARFGAP3 | 0.05937 | 65.22 | 1.92 |
| GLYATL1 + OBSCN + CLDN7 | 0.05997 | 74.48 | 1.91 |
| GLYATL1 + OBSCN + FAM83H + CLDN7 | 0.05997 | 74.4 | 1.91 |
| CLDN7 | 0.0603 | 66.78 | 1.92 |
| OBSCN + STRA13 + FAM83 | 0.06116 | 63.94 | 1.9 |
| OBSCN + STRA13 + WHSC1 | 0.06164 | 64.71 | 1.9 |
| WHSC1 + B3GNT9 + ARFGAP3 | 0.06233 | 66.69 | 1.9 |
| WHSC1 + B3GNT9 + KDM2A | 0.0645 | 68.22 | 1.88 |
| STRA13 + WHSC1 + ARFGAP3 | 0.06602 | 66.83 | 1.88 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| STRA13 + CNOT6 + B3GNT9 | 0.0667 | 64.11 | 1.88 |
| STRA13 + WHSC1 + B3GNT9 + KDM2A | 0.0672 | 68.3 | 1.87 |
| STRA13 + CNOT6 + B3GNT9 + KDM2A | 0.06729 | 63.02 | 1.88 |
| STRA13 + WHSC1 + CNOT6 + B3GNT9 | 0.06836 | 67.73 | 1.87 |
| STRA13 + FAM83H + CNOT6 + B3GNT9 | 0.06938 | 63.56 | 1.87 |
| WHSC1 + ARFGAP3 | 0.07015 | 65.5 | 1.86 |
| FAM83H + ARFGAP3 | 0.07018 | 63.34 | 1.88 |
| GLYATL1 + OBSCN | 0.0712 | 65.09 | 1.86 |
| GLYATL1 + OBSCN + CNOT6 | 0.0712 | 65.09 | 1.86 |
| OBSCN + STRA13 + FAM83H + KDM2A | 0.07188 | 61.27 | 1.85 |
| STRA13 + FAM83H + CNOT6 | 0.07243 | 62.64 | 1.85 |
| FAM83H + CNOT6 + ARFGAP3 | 0.07322 | 64.3 | 1.86 |
| WHSC1 + KDM2A + ARFGAP3 | 0.07368 | 65.22 | 1.85 |
| GLYATL1 + CNOT6 + B3GNT9 | 0.07619 | 66.53 | 1.84 |
| STRA13 + WHSC1 + CNOT6 + ARFGAP3 | 0.0773 | 68.33 | 1.83 |
| FAM83H + B3GNT9 + KDM2A | 0.07904 | 62.34 | 1.83 |
| KDM2A | 0.08018 | 58.44 | 1.83 |
| FAM83H + KDM2A | 0.08018 | 58.47 | 1.83 |
| WHSC1 + FAM83H + B3GNT9 | 0.0823 | 65.77 | 1.81 |
| FAM83H + WHSC1 + CNOT6 + B3GNT9 | 0.0828 | 66.01 | 1.81 |
| GLYATL1 + FAM83H + CNOT6 + KDM2A | 0.08453 | 64.3 | 1.81 |
| OBSCN + FAM83H + CNOT6 + ARFGAP3 | 0.08542 | 64.3 | 1.82 |
| OBSCN + STRA13 + KDM2A | 0.08671 | 61.03 | 1.8 |
| OBSCN + KDM2A | 0.08674 | 59.4 | 1.8 |
| CNOT6 + B3GNT9 + KDM2A + ARFGAP3 | 0.08798 | 64.95 | 1.79 |
| OBSCN + WHSC1 + KDM2A + ARFGAP3 | 0.08814 | 65.01 | 1.79 |
| OBSCN + WHSC1 + CNOT6 + ARFGAP3 | 0.09062 | 64.76 | 1.78 |
| GLYATL1 + FAM83H + WHSC1 | 0.09081 | 69.31 | 1.78 |
| GLYATL1 + FAM83H + WHSC1 + CNOT6 | 0.09081 | 69.14 | 1.78 |
| GLYATL1 + OBSCN + FLNA + FAM83H | 0.09413 | 69.53 | 1.77 |
| GLYATL1 + FAM83H + KDM2A | 0.09451 | 64.05 | 1.77 |
| STRA13 + FAM83H + ARFGAP3 | 0.09488 | 66.15 | 1.77 |
| OBSCN + STRA13 + FAM83H + ARFGAP3 | 0.09488 | 66.34 | 1.77 |
| STRA13 + FAM83H + B3GNT9 + ARFGAP3 | 0.09488 | 65.71 | 1.77 |
| WHSC1 + B3GNT9 | 0.09761 | 66.31 | 1.76 |
| WHSC1 + CNOT6 + B3GNT9 | 0.09816 | 66.07 | 1.76 |
| FAM83H + CNOT6 + KDM2A + ARFGAP3 | 0.09845 | 63.4 | 1.76 |
| OBSCN + FAM83H + CNOT6 | 0.1032 | 59.86 | 1.75 |
| STRA13 + B3GNT9 + ARFGAP3 | 0.1034 | 65.99 | 1.75 |
| OBSCN + STRA13 + B3GNT9 + ARFGAP3 | 0.1034 | 66.09 | 1.75 |
| WHSC1 + CNOT6 + ARFGAP3 | 0.1042 | 64.84 | 1.74 |
| OBSCN + B3GNT9 + KDM2A | 0.1069 | 62.69 | 1.74 |
| OBSCN + FAM83H + CNOT6 + B3GNT9 | 0.1083 | 62.94 | 1.73 |
| STRA13 + FAM83H + CNOT6 + ARFGAP3 | 0.1102 | 66.97 | 1.73 |
| OBSCN + FAM83H + KDM2A | 0.1115 | 58.91 | 1.72 |
| OBSCN + FAM83H + B3GNT9 + KDM2A | 0.1148 | 62.58 | 1.72 |
| STRA13 + ARFGAP3 | 0.1155 | 66.48 | 1.71 |
| STRA13 + B3GNT9 | 0.1237 | 64.08 | 1.69 |
| GLYATL1 + OBSCN + CLDN7 + CNOT6 | 0.1257 | 74.86 | 1.68 |
| OBSCN + WHSC1 + B3GNT9 + ARFGAP3 | 0.1276 | 65.9 | 1.68 |
| CNOT6 + B3GNT9 + KDM2A | 0.1339 | 61.44 | 1.67 |
| STRA13 + FAM83H + B3GNT9 | 0.1441 | 64 | 1.64 |
| STRA13 + FAM83H + CNOT6 + KDM2A | 0.1444 | 61.14 | 1.64 |
| OBSCN + FAM83H + WHSC1 + B3GNT9 | 0.1482 | 65.55 | 1.63 |
| FAM83H + CNOT6 + KDM2A | 0.1496 | 59.12 | 1.63 |
| GLYATL1 + FAM83H | 0.1543 | 65.77 | 1.62 |
| GLYATL1 + FAM83H + CNOT6 | 0.1543 | 65.55 | 1.62 |
| STRA13 + CNOT6 + KDM2A | 0.1559 | 60.73 | 1.62 |
| GLYATL1 + CNOT6 | 0.1579 | 64.71 | 1.61 |
| STRA13 + CNOT6 | 0.1592 | 62.99 | 1.61 |
| OBSCN + WHSC1 + CNOT6 + B3GNT9 | 0.1616 | 65.52 | 1.61 |
| STRA13 + FAM83H + WHSC1 + B3GNT9 | 0.1638 | 67.43 | 1.6 |
| STRA13 + WHSC1 + KDM2A + ARFGAP3 | 0.1641 | 66.8 | 1.6 |
| CNOT6 + KDM2A | 0.1644 | 58.09 | 1.61 |
| GLYATL1 + OBSCN + FAM83H + KDM2A | 0.1758 | 64.08 | 1.58 |
| OBSCN + STRA13 + WHSC1 + ARFGAP3 | 0.1787 | 67.21 | 1.58 |
| CNTO6 + KDM2A + ARFGAP3 | 0.1804 | 63.7 | 1.57 |
| OBSCN + CNOT6 + KDM2A + ARFGAP3 | 0.1804 | 63.32 | 1.57 |
| STRA13 + WHSC1 | 0.1884 | 64.65 | 1.56 |
| OBSCN + WHSC1 + ARFGAP3 | 0.1905 | 64.6 | 1.56 |
| STRA13 + WHSC1 + B3GNT9 | 0.1928 | 66.67 | 1.55 |
| WHSC1 + CNOT6 + B3GNT9 + ARFGAP3 | 0.1929 | 67.02 | 1.55 |
| OBSCN + FAM83H + B3GNT9 | 0.1997 | 62.25 | 1.54 |
| OBSCN + CNOT6 + KDM2A | 0.2285 | 59.61 | 1.5 |

TABLE 6-continued

Relative ability of the candidate genes (single, two-, three- and four gene combinations) to predict the recurrence risk in prostate cancer patients

| Gene combinations | p-Value | Concordance Index | Risk groups hazard ratio |
|---|---|---|---|
| OBSCN + FAM83H + CNOT6 + KDM2A | 0.2285 | 59.72 | 1.5 |
| OBSCN + WHSC1 + B3GNT9 | 0.2763 | 65.5 | 1.44 |
| STRA13 + KDM2A | 0.2929 | 60.81 | 1.43 |
| STRA13 + FAM83H + KDM2A | 0.2929 | 61.03 | 1.43 |
| OBSCN + STRA13 + WHSC1 + B3GNT9 | 0.2944 | 66.53 | 1.42 |
| STRA13 | 0.3044 | 62.72 | 1.41 |
| FAM83H | 0.3193 | 59.86 | 1.4 |
| WHSC1 + CNOT6 | 0.3242 | 62.66 | 1.39 |
| OBSCN + WHSC1 + CNOT6 | 0.3303 | 62.34 | 1.39 |
| OBSCN | 0.3312 | 58.66 | 1.39 |
| OBSCN + CNOT6 | 0.3312 | 58.88 | 1.39 |
| OBSCN + WHSC1 | 0.3526 | 62.69 | 1.37 |
| OBSCN + FAM83H | 0.3557 | 59.64 | 1.36 |
| WHSC1 | 0.3572 | 62.85 | 1.36 |
| STRA13 + FAM83H | 0.3612 | 62.45 | 1.36 |
| OBSCN + B3GNT9 | 0.3913 | 61.3 | 1.33 |
| OBSCN + CNOT6 + B3GNT9 | 0.3988 | 61.27 | 1.33 |
| FAM83H + B3GNT9 | 0.4328 | 61.47 | 1.3 |
| FAM83H + CNOT6 + B3GNT9 | 0.4433 | 61.6 | 1.29 |
| OBSCN + STRA13 + CNOT6 + KDM2A | 0.5296 | 61.41 | 1.23 |
| FAM83H + CNOT6 | 0.5317 | 59.72 | 1.23 |
| WHSC1 + FAM83H | 0.56 | 61.87 | 1.21 |
| OBSCN + FAM83H + WHSC1 | 0.56 | 61.79 | 1.21 |
| WHSC1 + FAM83H + CNOT6 | 0.56 | 61.93 | 1.21 |
| OBSCN + FAM83H + WHSC1 + CNOT6 | 0.56 | 61.76 | 1.21 |
| B3GNT9 | 0.8225 | 56.35 | 0.93 |
| CNOT6 | 0.9283 | 56.05 | 1.03 |
| CNOT6 + B3GNT9 | 0.9544 | 58.12 | 0.98 |

Discussion

Insertional mutagenesis screens are valuable tools for identifying genes associated with cancer. Here for the first time, a LV-mediated insertional mutagenesis screen was performed in an orthotopic mouse model to discover genes associated with PC. Injection of LV-mutagenized LNCaP cells into the prostate efficiently induced tumors in mouse prostates approximately 3 weeks after injections and these tumors regressed after castration. Similar to PC progression post androgen deprivation therapy in cancer patients, it was observed that tumors reemerged in the castrated mice. In this approach, tumors that develop in castrated mice have a selective advantage to proliferate in an androgen deficient environment. This is due to provirus integrations that dysregulate nearby genes, thereby triggering AIPC. Analyzing the proviral integration sites, eleven candidate AIPC genes were identified. Three of the candidate genes were identified in/near CISs and another eight candidate genes were identified by performing meta-analysis of all genes in/near the 79 androgen independent primary tumor unique integrations sites. The CISs are within the genes OBSCN, KDM2A, and ARFGAP3 on Chr1, Chr11 and Chr22, respectively. OBSCN (Obscurin, Cytoskeletal Calmodulin And Titin-Interacting RhoGEF) is a calmodulin binding protein with serine/threonine kinase activity involved in myofibrillogenesis. OBSCN is highly mutated in various cancers including breast [77] and colorectal cancers [78]. Loss of OBSCN was reported to disrupt cell-cell contact and enhance mesenchymal transitions in breast carcinoma [77]. The gene KDM2A encodes a lysine-specific demethylase protein that binds to CpG islands and demethylates histone residues in H3K36 protein, highlighting its role in heterochromatin modulations and gene regulation by epigenetic modifications. Previously, KDM2A expression was reported to promote cell growth and migration in gastric cancer [79] and activate ERK1/2 signaling promoting lung tumorigenesis and metastasis [80]. Frescas et al. (2008) reported low levels of KDM2A in PC tissues using Oncomine [81]. Low levels of KDM2A were suggested to contribute in centromeric rearrangements and mitotic aberration that play a crucial role in PC progression [81]. The above described function of KDM2A combined with the observations described herein showing the enrichment of clones with CISs targeting KDM2A gene are consistent with dysregulation of KDM2A promoting AIPC. The gene near the second CIS, ARFGAP3, was previously reported as a novel androgen-regulated gene that promotes PC cell proliferation and migration [82].

In addition to the three candidate genes near the CISs, eight other genes (GLYATL1, FLNA, STRA13, WHSC1, FAM83H, CLDN7, CNOT6, and B3GNT9) were identified in this screen. These genes had various functions like cytoskeleton organization (FLNA, CLD7, FAM83H, and OBSCN), epigenetic regulation (WSHC1, KDM2A), protein glycosylation (B3GNT9, GLYATL1), DNA damage repair (STRA13), protein transport (ARFGAP3) and RNA regulation (CNOT6) (Table 7). GLYATL1, FLNA, STRA13, WHSC1, CLDN7 and FAM83H were previously shown to be associated with various cancers, while B3GNT9 and CNOT6 genes are novel candidate genes which to our knowledge have not been previously associated with any cancer. B3GNT9 gene encodes a protein with galactosyltransferase activity and to our knowledge has not been linked to any cancer. CNOT6 encodes the catalytic component of the CCR4-NOT core transcriptional regulation complex, which has a 3'-5' RNase activity and play a role in miRNA-mediated repression, mRNA degradation, and transcriptional regulation.

TABLE 7

Candidate gene description and function

| Candidate gene | Description | Functions |
|---|---|---|
| OBSCN | Obscurin, cytoskeletal calmodulin and titin-interacting RhoGEF | Serine/threonine kinase activity and calmodulin binding |
| FLNA | Filamin A | Actin binding protein; Regulates cytoskeleton reorganisation by interacting with integrins, membrane receptors and signaling molecules |
| CLDN7 | Claudin 7 | Formation of tight junctions, play role in maintaining cell polarity and signal transductions |
| FAM83H | Family with seuquence similarity 83, Member H | Structural development and calcificiation of tooth; Keratin cytoskeleton rearangement |
| KDM2A | Lysine-specific Histone demethyalse2A | Epigenetic regulation and maintains hetrochrnomatin state |
| WHSC1 | Wolf-Hirschhorn syndrome candidate1 | Chromatin binding and Histone-Lysine specific methyltransferase functions |
| B3GNT9 | UDP-GlcNAc: BetaGal Beta-1.3-N-Acetylglucosaminyltransferase | Galactosyltransferase activity Protein glycosylation |
| GLYATL1 | Glycine N-acyltransferase like-1 | N-acyltransferase activity |
| ARFGAP3 | ADP-Ribosylation Factor GTPase-Activating protein 3 | Regulates early secretory pathways of proteins |
| STRA13 | Stimualted by Retinoic Acid 13 | Interacts with Fanconi anemia (FA) nuclear complex to facilitate DNA repair |
| CNOT6 | CCR4-NOT Transcription complex, subunit 6 | RNA binding and play a role in miRNA-mediated repression, mRNA degration and transcritional regulation |

FAM83H gene encodes a protein involved in structural organization and calcification of tooth enamel. FAM83H along with casein kinase1α was reported to regulate keratin cytoskeleton rearrangement and contribute to progression of colorectal cancer cells [83]. GLYATL1 encodes glycine N-acyltransferase like1 protein and is reported to play a role in carcinogenesis in liver cancer [84]. STRA13 (Stimulate by Retinoic acid 13) is a double-strand DNA binding protein that interacts with Fanconi anemia (FA) nuclear core complex which regulated DNA damage response and repair and genome maintenance [85, 86]. FLNA (Filamin Alpha) is an actin-binding protein that links actin with membrane glycoproteins. FLNA regulates cell shape and migrations by remodeling and regulating cytoskeleton, and is known to interact with integrins, transmembrane receptor complexes and second messengers. FLNA expression was previously reported to correlate with proliferation and invasive properties of several human cancers including melanoma [87], renal [88], breast [89], lung [90], leukemia [91], gastric [92] and prostate [93] cancer. Castoria et al. (2011) and Giovannelli et al. (2014) reported that FLNA/androgen receptor complex activates signaling associated with cell migration and motility in prostate cancer [94, 95]. Moreover, nuclear localization of FLNA was reported to enhance androgen responsiveness of prostate cancer [96]. WHSC1 (Wolf-Hirschhorn Syndrome Candidate 1) has chromatin binding with histone-lysine N-methyltransferase activity and was previously implicated with the progression of several cancers including prostate cancer. WHSC1 was shown to epigenetically regulate the expression of TWIST and other metastatic-related genes to promote progression of prostate [97] and lung cancers [98]. Recently, WHSC1 was reported to promote squamous cell carcinoma of the head and neck via regulating NIMA-related kinase-7 activity through H3K36me2 mediated regulation [99]. CLDN7 was reported to be differentially expressed in several cancers, including PC. CLDN7 is a member of claudins family which are membrane protein and components of tight junctions that regulate cell polarity and signal transduction events. CLDN7 was shown to regulate prostate specific antigen (PSA) expression in LNCaP cells [100, 101]. Interestingly, one other candidate gene, ARFGAP3, was shown to enhance the androgen receptor-mediated transactivation activity of prostate-specific antigen in LNCaP cells [82]. Without being bound by theory, this could be the reason why the combinations of other genes with ARFGAP3 and CLDN7 was highly predictive in assessing the clinical outcome of PC patients (see table 6; 8 out of the top 10 combinations includes ARFGAP3 and CLDN7). The dataset used for the prognostication studies [34] measured recurrence risk based on PSA levels, which is reported to be regulated by CLDN7 and ARFGAP3.

In general cancer-associated genes are genetically altered in cancer patients. Previously, it has been shown that prostate cancer progression is most often the result of chromosomal rearrangements and gene mutations [102]. The loss of TP53 and PTEN have been shown to be very common genetic alterations found in AIPC [103, 104]. Cho et al (2015) have suggested that in addition to PTEN and TP53, several other genetic alterations are important for AIPC emergence [102]. At least four of the candidate genes described herein (FAM83H, OBSCN, CLDN7 and STRA13) were frequently altered in PC patients, suggesting that dysregulation of these genes triggered AIPC.

Taken together this study identified novel genes which are differentially expressed in PC samples. Importantly, the candidate genes identified in this screen have prognostic value and predicted recurrence risk in PC patients.

REFERENCES

1. Uren A G, Kool J, Berns A, van Lohuizen M. Retroviral insertional mutagenesis: past, present and future. Oncogene. 2005; 24:7656-7672.
2. Trobridge G D. Genotoxicity of retroviral hematopoietic stem cell gene therapy. Expert Opin Biol Ther. 2011; 11:581-593. doi: 10.1517/14712598.2011.562496
3. Landrette S F, Xu T. Somatic genetics empowers the mouse for modeling and interrogating developmental and disease processes. PLoS Genet. 2011; 7:e1002110.
4. Ranzani M, Cesana D, Bartholomae C C, Sanvito F, Pala M, Benedicenti F, Gallina P, Sergi L S, Merella S, Bulfone A, Doglioni C, von Kalle C, Kim Y J, Schmidt M, Tonon G, Naldini L, Montini E. Lentiviral vector-based insertional mutagenesis identifies genes associated with liver cancer. Nat Methods. 2013; 10:155-161.
5. Collier L S, Carlson C M, Ravimohan S, Dupuy A J, Largaespada D A. Cancer gene discovery in solid tumours using transposon-based somatic mutagenesis in the mouse. Nature. 2005; 436:272-276.
6. Hacein-Bey-Abina S, Garrigue A, Wang G P, Soulier J, Lim A, Morillon E, Clappier E, Caccavelli L, Delabesse E, Beldjord K, Asnafi V, MacIntyre E, Dal Cortivo L, Radford I, Brousse N, Sigaux F, Moshous D, Hauer J, Borkhardt A, Belohradsky B H, Wintergerst U, Velez M C, Leiva L, Sorensen R, Wulffraat N, Blanche S, Bushman F D, Fischer A, Cavazzana-Calvo M. Insertional oncogenesis in 4 patients after retrovirus-mediated gene therapy of SCID-X1. J Clin Invest. 2008; 118:3132-3142.
7. Hacein-Bey-Abina S, Von Kalle C, Schmidt M, McCormack M P, Wulffraat N, Leboulch P, Lim A, Osborne C S, Pawliuk R, Morillon E, Sorensen R, Forster A, Fraser P, Cohen J I, de Saint Basile G, Alexander I, Wintergerst U, Frebourg T, Aurias A, Stoppa-Lyonnet D, Romana S, Radford-Weiss I, Gross F, Valensi F, Delabesse E, Macintyre E, Sigaux F, Soulier J, Leiva L E, Wissler M. et al. LMO2-associated clonal T cell proliferation in two patients after gene therapy for SCID-X1. Science. 2003; 302:415-419.
8. Visakorpi T. The molecular genetics of prostate cancer. Urology. 2003; 62:3-10.
9. Nelson W G, De Marzo A M, Isaacs W B. Prostate cancer. N Engl J Med. 2003; 349:366-381.
10. Porkka K P, Visakorpi T. Molecular mechanisms of prostate cancer. Eur Urol. 2004; 45:683-691.
11. Lu S, Tsai S Y, Tsai M J. Molecular mechanisms of androgen-independent growth of human prostate cancer LNCaP-AI cells. Endocrinology. 1999; 140:5054-5059.
12. Gulley J, Figg W D, Dahut W L. Treatment options for androgen-independent prostate cancer. Clin Adv Hematol Oncol. 2003; 1:49-57.
13. Marech I, Vacca A, Ranieri G, Gnoni A, Dammacco F. Novel strategies in the treatment of castration-resistant prostate cancer (Review) Int J Oncol. 2012; 40:1313-1320.
14. Pousette A, Carlstrom K, Henriksson P, Grande M, Stege R. Use of a hormone-sensitive (LNCaP) and a hormone-resistant (LNCaP-r) cell line in prostate cancer research. Prostate. 1997; 31:198-203.
15. Iguchi K, Ishii K, Nakano T, Otsuka T, Usui S, Sugimura Y, Hirano K. Isolation and characterization of LNCaP sublines differing in hormone sensitivity. J Androl. 2007; 28:670-678.
16. Horoszewicz J S, Leong S S, Kawinski E, Karr J P, Rosenthal H, Chu T M, Mirand E A, Murphy G P. LNCaP model of human prostatic carcinoma. Cancer Res. 1983; 43:1809-1818.
17. Sato N, Gleave M E, Bruchovsky N, Rennie P S, Beraldi E, Sullivan L D. A metastatic and androgen-sensitive human prostate cancer model using intraprostatic inoculation of LNCaP cells in SCID mice. Cancer Res. 1997; 57:1584-1589.
18. Rahrmann E P, Collier L S, Knutson T P, Doyal M E, Kuslak S L, Green L E, Malinowski R L, Roethe L, Akagi K, Waknitz M, Huang W, Largaespada D A, Marker P C. Identification of PDE4D as a proliferation promoting factor in prostate cancer using a Sleeping Beauty transposon-based somatic mutagenesis screen. Cancer Res. 2009; 69:4388-4397.
19. Heim D, Cornils K, Schulze K, Fehse B, Lohse A W, Brummendorf T H, Wege H. Retroviral insertional mutagenesis in telomerase-immortalized hepatocytes identifies RIPK4 as novel tumor suppressor in human hepatocarcinogenesis. Oncogene. 2014.
20. Montini E, Cesana D, Schmidt M, Sanvito F, Bartholomae C C, Ranzani M, Benedicenti F, Sergi L S, Ambrosi A, Ponzoni M, Doglioni C, Di Serio C, von Kalle C, Naldini L. The genotoxic potential of retroviral vectors is strongly modulated by vector design and integration site selection in a mouse model of HSC gene therapy. J Clin Invest. 2009; 119:964-975.
21. Trobridge G D, Miller D G, Jacobs M A, Allen J M, Kiem H P, Kaul R, Russell D W. Foamy virus vector integration sites in normal human cells. Proc Natl Acad Sci USA. 2006; 103:1498-1503.
22. Sharifi N, Gulley J L, Dahut W L. Androgen deprivation therapy for prostate cancer. Jama. 2005; 294:238-244.
23. Wang X, An Z, Geller J, Hoffman R M. High-malignancy orthotopic nude mouse model of human prostate cancer LNCaP. Prostate. 1999; 39:182-186.
24. Shultz L D, Lyons B L, Burzenski L M, Gott B, Chen X, Chaleff S, Kotb M, Gillies S D, King M, Mangada J, Greiner D L, Handgretinger R. Human lymphoid and myeloid cell development in NOD/LtSz-scid IL2R gamma null mice engrafted with mobilized human hemopoietic stem cells. J Immunol. 2005; 174:6477-6489.
25. Rhodes D R, Yu J, Shanker K, Deshpande N, Varambally R, Ghosh D, Barrette T, Pandey A, Chinnaiyan A M. ONCOMINE: a cancer microarray database and integrated data-mining platform. Neoplasia. 2004; 6:1-6.
26. Arredouani M S, Lu B, Bhasin M, Eljanne M, Yue W, Mosquera J M, Bubley G J, Li V, Rubin M A, Libermann T A, Sanda M G. Identification of the transcription factor single-minded homologue 2 as a potential biomarker and immunotherapy target in prostate cancer. Clin Cancer Res. 2009; 15:5794-5802.
27. Grasso C S, Wu Y M, Robinson D R, Cao X, Dhanasekaran S M, Khan A P, Quist M J, Jing X, Lonigro R J, Brenner J C, Asangani I A, Ateeq B, Chun S Y, Siddiqui J, Sam L, Anstett M, Mehra R, Prensner J R, Palanisamy N, Ryslik G A, Vandin F, Raphael B J, Kunju L P, Rhodes D R, Pienta K J, Chinnaiyan A M, Tomlins S A. The mutational landscape of lethal castration-resistant prostate cancer. Nature. 2012; 487:239-243.

28. Holzbeierlein J, Lal P, LaTulippe E, Smith A, Satagopan J, Zhang L, Ryan C, Smith S, Scher H, Scardino P, Reuter V, Gerald W L. Gene expression analysis of human prostate carcinoma during hormonal therapy identifies androgen-responsive genes and mechanisms of therapy resistance. Am J Pathol. 2004; 164:217-227.

29. Lapointe J, Li C, Higgins J P, van de Rijn M, Bair E, Montgomery K, Ferrari M, Egevad L, Rayford W, Bergerheim U, Ekman P, DeMarzo A M, Tibshirani R, Botstein D, Brown P O, Brooks J D, Pollack J R. Gene expression profiling identifies clinically relevant subtypes of prostate cancer. Proc Natl Acad Sci USA. 2004; 101:811-816.

30. Liu P, Ramachandran S, Ali Seyed M, Scharer C D, Laycock N, Dalton W B, Williams H, Karanam S, Datta M W, Jaye D L, Moreno C S. Sex-determining region Y box 4 is a transforming oncogene in human prostate cancer cells. Cancer Res. 2006; 66:4011-4019.

31. Luo J H, Yu Y P, Cieply K, Lin F, Deflavia P, Dhir R, Finkelstein S, Michalopoulos G, Becich M. Gene expression analysis of prostate cancers. Mol Carcinog. 2002; 33:25-35.

32. Magee J A, Araki T, Patil S, Ehrig T, True L, Humphrey P A, Catalona W J, Watson M A, Milbrandt J. Expression profiling reveals hepsin overexpression in prostate cancer. Cancer Res. 2001; 61:5692-5696.

33. Singh D, Febbo P G, Ross K, Jackson D G, Manola J, Ladd C, Tamayo P, Renshaw A A, D'Amico A V, Richie J P, Lander E S, Loda M, Kantoff P W, Golub T R, Sellers W R. Gene expression correlates of clinical prostate cancer behavior. Cancer Cell. 2002; 1:203-209.

34. Taylor B S, Schultz N, Hieronymus H, Gopalan A, Xiao Y, Carver B S, Arora V K, Kaushik P, Cerami E, Reva B, Antipin Y, Mitsiades N, Landers T, Dolgalev I, Major J E, Wilson M, Socci N D, Lash A E, Heguy A, Eastham J A, Scher H I, Reuter V E, Scardino P T, Sander C, Sawyers C L, Gerald W L. Integrative genomic profiling of human prostate cancer. Cancer Cell. 2010; 18:11-22.

35. Tomlins S A, Mehra R, Rhodes D R, Cao X, Wang L, Dhanasekaran S M, Kalyana-Sundaram S, Wei J T, Rubin M A, Pienta K J, Shah R B, Chinnaiyan A M. Integrative molecular concept modeling of prostate cancer progression. Nat Genet. 2007; 39:41-51.

36. Vanaja D K, Cheville J C, Iturria S J, Young C Y. Transcriptional silencing of zinc finger protein 185 identified by expression profiling is associated with prostate cancer progression. Cancer Res. 2003; 63:3877-3882.

37. Varambally S, Yu J, Laxman B, Rhodes D R, Mehra R, Tomlins S A, Shah R B, Chandran U, Monzon F A, Becich M J, Wei J T, Pienta K J, Ghosh D, Rubin M A, Chinnaiyan A M. Integrative genomic and proteomic analysis of prostate cancer reveals signatures of metastatic progression. Cancer Cell. 2005; 8:393-406.

38. Wallace T A, Prueitt R L, Yi M, Howe T M, Gillespie J W, Yfantis H G, Stephens R M, Caporaso N E, Loffredo C A, Ambs S. Tumor immunobiological differences in prostate cancer between African-American and European-American men. Cancer Res. 2008; 68:927-936.

39. Welsh J B, Sapinoso L M, Su A I, Kern S G, Wang-Rodriguez J, Moskaluk C A, Frierson H F Jr, Hampton G M. Analysis of gene expression identifies candidate markers and pharmacological targets in prostate cancer. Cancer Res. 2001; 61:5974-5978.

40. Lin B, White J T, Lu W, Xie T, Utleg A G, Yan X, Yi E C, Shannon P, Khrebtukova I, Lange P H, Goodlett D R, Zhou D, Vasicek T J, Hood L. Evidence for the presence of disease-perturbed networks in prostate cancer cells by genomic and proteomic analyses: a systems approach to disease. Cancer Res. 2005; 65:3081-3091.

41. Maher C A, Kumar-Sinha C, Cao X, Kalyana-Sundaram S, Han B, Jing X, Sam L, Barrette T, Palanisamy N, Chinnaiyan A M. Transcriptome sequencing to detect gene fusions in cancer. Nature. 2009; 458:97-101.

42. Maher C A, Palanisamy N, Brenner J C, Cao X, Kalyana-Sundaram S, Luo S, Khrebtukova I, Barrette T R, Grasso C, Yu J, Lonigro R J, Schroth G, Kumar-Sinha C, Chinnaiyan A M. Chimeric transcript discovery by paired-end transcriptome sequencing. Proc Natl Acad Sci USA. 2009; 106:12353-12358.

43. Lapointe J, Li C, Giacomini C P, Salari K, Huang S, Wang P, Ferrari M, Hernandez-Boussard T, Brooks J D, Pollack J R. Genomic profiling reveals alternative genetic pathways of prostate tumorigenesis. Cancer Res. 2007; 67:8504-8510.

44. Paris P L, Andaya A, Fridlyand J, Jain A N, Weinberg V, Kowbel D, Brebner J H, Simko J, Watson J E, Volik S, Albertson D G, Pinkel D, Alers J C, van der Kwast T H, Vissers K J, Schroder F H, Wildhagen M F, Febbo P G, Chinnaiyan A M, Pienta K J, Carroll P R, Rubin M A, Collins C, van Dekken H. Whole genome scanning identifies genotypes associated with recurrence and metastasis in prostate tumors. Hum Mol Genet. 2004; 13:1303-1313.

45. Khan A P, Poisson L M, Bhat V B, Fermin D, Zhao R, Kalyana-Sundaram S, Michailidis G, Nesvizhskii A I, Omenn G S, Chinnaiyan A M, Sreekumar A. Quantitative proteomic profiling of prostate cancer reveals a role for miR-128 in prostate cancer. Mol Cell Proteomics. 2010; 9:298-312.

46. Tomlins S A, Rubin M A, Chinnaiyan A M. Integrative biology of prostate cancer progression. Annu Rev Pathol. 2006; 1:243-271.

47. Vellaichamy A, Sreekumar A, Strahler J R, Rajendiran T, Yu J, Varambally S, Li Y, Omenn G S, Chinnaiyan A M, Nesvizhskii A I. Proteomic interrogation of androgen action in prostate cancer cells reveals roles of aminoacyl tRNA synthetases. PLoS One. 2009; 4:e7075.

48. Haffner M C, Aryee M J, Toubaji A, Esopi D M, Albadine R, Gurel B, Isaacs W B, Bova G S, Liu W, Xu J, Meeker A K, Netto G, De Marzo A M, Nelson W G, Yegnasubramanian S. Androgen-induced TOP2B-mediated double-strand breaks and prostate cancer gene rearrangements. Nat Genet. 2010; 42:668-675.

49. Mani R S, Tomlins S A, Callahan K, Ghosh A, Nyati M K, Varambally S, Palanisamy N, Chinnaiyan A M. Induced chromosomal proximity and gene fusions in prostate cancer. Science. 2009; 326:1230.

50. Armisen R, Marcelain K, Simon F, Tapia J C, Toro J, Quest A F, Stutzin A. TRPM4 enhances cell proliferation through up-regulation of the beta-catenin signaling pathway. J Cell Physiol. 2011; 226:103-109.

51. Fraser S P, Pardo L A. Ion channels: functional expression and therapeutic potential in cancer. Colloquium on Ion Channels and Cancer. EMBO Rep. 2008; 9:512-515.

52. Prevarskaya N, Flourakis M, Bidaux G, Thebault S, Skryma R. Differential role of TRP channels in prostate cancer. Biochem Soc Trans. 2007; 35:133-135.

53. Roginski R S, Mohan Raj B K, Birditt B, Rowen L. The human GRINL1A gene defines a complex transcription unit, an unusual form of gene organization in eukaryotes. Genomics. 2004; 84:265-276.

54. Le T P, Sun M, Luo X, Kraus W L, Greene G L. Mapping ERbeta genomic binding sites reveals unique genomic features and identifies EBF1 as an ERbeta interactor. PLoS One. 2013; 8:e71355.

55. Hartman J, Strom A, Gustafsson J A. Current concepts and significance of estrogen receptor beta in prostate cancer. Steroids. 2012; 77:1262-1266.
56. Aung C S, Hill M M, Bastiani M, Parton R G, Parat M O. PTRF-cavin-1 expression decreases the migration of PC3 prostate cancer cells: role of matrix metalloprotease 9. Eur J Cell Biol. 2011; 90:136-142.
57. Gould M L, Williams G, Nicholson H D. Changes in caveolae, caveolin, and polymerase 1 and transcript release factor (PTRF) expression in prostate cancer progression. Prostate. 2010; 70:1609-1621.
58. Nassar Z D, Moon H, Duong T, Neo L, Hill M M, Francois M, Patron R G, Parat M O. PTRF/Cavin-1 decreases prostate cancer angiogenesis and lymphangiogenesis. Oncotarget. 2013; 4:1844-1855.
59. Moon H, Lee C S, Inder K L, Sharma S, Choi E, Black D M, Le Cao K A, Winterford C, Coward J I, Ling M T, Craik D J, Parton R G, Russell P J, Hill M M, the Australian Prostate Cancer BioResource. PTRF/cavin-1 neutralizes non-caveolar caveolin-1 microdomains in prostate cancer. Oncogene. 2013.
60. Buchet-Poyau K, Courchet J, Le Hir H, Seraphin B, Scoazec J Y, Duret L, Domon-Dell C, Freund J N, Billaud M. Identification and characterization of human Mex-3 proteins, a novel family of evolutionarily conserved RNA-binding proteins differentially localized to processing bodies. Nucleic Acids Res. 2007; 35:1289-1300.
61. Mougeot J L, Bahrani-Mougeot F K, Lockhart P B, Brennan M T. Microarray analyses of oral punch biopsies from acute myeloid leukemia (AML) patients treated with chemotherapy. Oral Surg Oral Med Oral Pathol Oral Radiol Endod. 2011; 112:446-452.
62. Wang Z G, Ackerman S H. The assembly factor Atp1 1p binds to the beta-subunit of the mitochondrial F(1)-ATPase. J Biol Chem. 2000; 275:5767-5772.
63. Sanchez-Cenizo L, Formentini L, Aldea M, Ortega A D, Garcia-Huerta P, Sanchez-Arago M, Cuezva J M. Up-regulation of the ATPase inhibitory factor 1 (IF1) of the mitochondrial H+-ATP synthase in human tumors mediates the metabolic shift of cancer cells to a Warburg phenotype. J Biol Chem. 2010; 285:25308-25313.
64. Trobridge G D, Wu R A, Hansen M, Ironside C, Watts K L, Olsen P, Beard B C, Kiem H P. Cocal-pseudotyped lentiviral vectors resist inactivation by human serum and efficiently transduce primate hematopoietic repopulating cells. Mol Ther. 2010; 18:725-733.
65. Kent W J. BLAT—the BLAST-like alignment tool. Genome Res. 2002; 12:656-664.
66. Chapman D G. The Estimation of Biological Populations. Ann Math Stat. 1954; 25:1-14.
67. Krebs C J. Ecological Methodology. 2. Menlo Park, Calif.: Addison Wesley Longman, Inc.; 1998. From Chapter 2 Estimating Abundance: Mark-Recapture Techniques; pp. 35-41.
68. Aguirre-Gamboa R, Gomez-Rueda H, Martinez-Ledesma E, Martinez-Torteya A, Chacolla-Huaringa R, Rodriguez-Barrientos A, Tamez-Pena J G, Trevino V. SurvExpress: an online biomarker validation tool and database for cancer gene expression data using survival analysis. PloS one. 2013; 8(9):e74250.
69. Siegel R L, Miller K D, Jemal A. Cancer statistics, 2015. C A Cancer J Clin. 2015; 65:5-29.
70. Ranzani M, Annunziato S, Calabria A, et al. Lentiviral vector-based insertional mutagenesis identifies genes involved in the resistance to targeted anticancer therapies. Mol Ther. United States; 2014:2056-2068.
71. Stephenson R A, Dinney C P, Gohji K, et al. Metastatic model for human prostate cancer using orthotopic implantation in nude mice. J Natl Cancer Inst. 1992; 84:951-957.
72. Schinke E N, Bii V, Nalla A, et al. A novel approach to identify driver genes involved in androgen-independent prostate cancer. Molecular cancer. 2014; 13:120.
73. Beard B C, Adair J E, Trobridge G D, et al. High-throughput genomic mapping of vector integration sites in gene therapy studies. Methods in molecular biology (Clifton, N.J. 2014; 1185:321-344.
74. Hocum J D, Battrell L R, Maynard R, et al. VISA-Vector Integration Site Analysis Server: A Web-Based Server To Rapidly Identify Retroviral Integration Sites From Next-Generation Sequencing. MOLECULAR THERAPY. Vol 22: NATURE PUBLISHING GROUP 75 VARICK S T, 9T H FLR, NEW YORK, N Y 10013-1917 USA; 2014: S84-S84.
75. Cerami E, Gao J, Dogrusoz U, et al. The cBio cancer genomics portal: an open platform for exploring multidimensional cancer genomics data. Cancer Discov. 2012; 2:401-404.
76. Gulzar Z G, McKenney J K, Brooks J D. Increased expression of NuSAP in recurrent prostate cancer is mediated by E2F1. Oncogene. 2013; 32:70-77.
77. Shriver M, Stroka K M, Vitolo M I, et al. Loss of giant obscurins from breast epithelium promotes epithelial-to-mesenchymal transition, tumorigenicity and metastasis. Oncogene; 2014.
78. Huhn S, Bevier M, Pardini B, et al. Colorectal cancer risk and patients' survival: influence of polymorphisms in genes somatically mutated in colorectal tumors. Cancer Causes Control. 2014; 25:759-769.
79. Huang Y, Liu Y, Yu L, et al. Histone demethylase KDM2A promotes tumor cell growth and migration in gastric cancer. Tumour Biol. 2015; 36:271-278.
80. Wagner K W, Alam H, Dhar S S, et al. KDM2A promotes lung tumorigenesis by epigenetically enhancing ERK1/2 signaling. J Clin Invest. 2013; 123:5231-5246.
81. Frescas D, Guardavaccaro D, Kuchay S M, et al. KDM2A represses transcription of centromeric satellite repeats and maintains the heterochromatic state. Cell Cycle. United States; 2008:3539-3547.
82. Obinata D, Takayama K, Urano T, et al. ARFGAP3, an androgen target gene, promotes prostate cancer cell proliferation and migration. Int J Cancer. 2012; 130:2240-2248.
83. Kuga T, Kume H, Kawasaki N, et al. A novel mechanism of keratin cytoskeleton organization through casein kinase Ialpha and FAM83H in colorectal cancer. J Cell Sci. England; 2013:4721-4731.
84. Matsuo M, Terai K, Kameda N, et al. Designation of enzyme activity of glycine-N-acyltransferase family genes and depression of glycine-N-acyltransferase in human hepatocellular carcinoma. Biochem Biophys Res Commun. United States: 2012 Elsevier Inc; 2012:901-906.
85. Yan Z, Delannoy M, Ling C, et al. A histone-fold complex and FANCM form a conserved DNA-remodeling complex to maintain genome stability. Mol Cell. United States: 2010 Elsevier Inc; 2010:865-878.
86. Singh T R, Saro D, Ali A M, et al. MHF1-MHF2, a histone-fold-containing protein complex, participates in the Fanconi anemia pathway via FANCM. Mol Cell. United States: 2010 Elsevier Inc; 2010:879-886.
87. Zhang K, Zhu T, Gao D, et al. Filamin A expression correlates with proliferation and invasive properties of human metastatic melanoma tumors: implications for survival in patients. J Cancer Res Clin Oncol. 2014; 140:1913-1926.
88. Sun G G, Wei C D, Jing S W, et al. Interactions between filamin A and MMP-9 regulate proliferation and invasion in renal cell carcinoma. Asian Pac J Cancer Prev. 2014; 15:3789-3795.
89. Tian H M, Liu X H, Han W, et al. Differential expression of filamin A and its clinical significance in breast cancer. Oncol Lett. 2013; 6:681-686.
90. Uramoto H, Akyurek L M, Hanagiri T. A positive relationship between filamin and VEGF in patients with lung cancer. Anticancer Res. 2010; 30:3939-3944.
91. Nguyen le X T, Chan S M, Ngo T D, et al. Interaction of TIF-90 and filamin A in the regulation of rRNA synthesis in leukemic cells. Blood. 2014; 124:579-589.
92. Sun G G, Sheng S H, Jing S W, et al. An antiproliferative gene FLNA regulates migration and invasion of gastric carcinoma cell in vitro and its clinical significance. Tumour Biol. 2014; 35:2641-2648.
93. Sun G G, Lu Y F, Zhang J, et al. Filamin A regulates MMP-9 expression and suppresses prostate cancer cell migration and invasion. Tumour Biol. 2014; 35:3819-3826.
94. Castoria G, D'Amato L, Ciociola A, et al. Androgen-induced cell migration: role of androgen receptor/filamin A association. PLoS One. 2011; 6:e17218.
95. Giovannelli P, Di Donato M, Auricchio F, et al. Analysis of the androgen receptor/filamin a complex in stromal cells. Methods Mol Biol. 2014; 1204:109-121.
96. Mooso B A, Vinall R L, Tepper C G, et al. Enhancing the effectiveness of androgen deprivation in prostate cancer by inducing Filamin A nuclear localization. Endocr Relat Cancer. 2012; 19:759-777.
97. Ezponda T, Popovic R, Shah M Y, et al. The histone methyltransferase MMSET/WHSC1 activates TWIST1 to promote an epithelial-mesenchymal transition and invasive properties of prostate cancer. Oncogene. 2013; 32:2882-2890.
98. Kuo C H, Chen K F, Chou S H, et al. Lung tumor-associated dendritic cell-derived resistin promoted cancer progression by increasing Wolf-Hirschhorn syndrome candidate 1/Twist pathway. Carcinogenesis. 2013; 34:2600-2609.
99. Saloura V, Cho H S, Kiyotani K, et al. WHSC1 Promotes Oncogenesis through Regulation of NIMA-Related Kinase-7 in Squamous Cell Carcinoma of the Head and Neck. Mol Cancer Res. 2015; 13:293-304.
100. Zheng J Y, Yu D, Foroohar M, et al. Regulation of the expression of the prostate-specific antigen by claudin-7. J Membr Biol. 2003; 194:187-197.
101. Wang Q, Zheng J Y, Kreth J, et al. Regulation of prostate-specific antigen expression by the junctional adhesion molecule A. Urology. United States; 2009:1119-1125.
102. Cho H, Herzka T, Stahihut C, et al. Rapid in vivo validation of candidate drivers derived from the PTEN-mutant prostate metastasis genome. Methods. 2015.
103. Martin P, Liu Y N, Pierce R, et al. Prostate epithelial Pten/TP53 loss leads to transformation of multipotential progenitors and epithelial to mesenchymal transition. Am J Pathol. United States: Published by Elsevier Inc.; 2011: 422-435.
104. Schlomm T, Iwers L, Kirstein P, et al. Clinical significance of p53 alterations in surgically treated prostate cancers. Mod Pathol. United States; 2008:1371-1378

While the invention has been described in terms of its preferred embodiments, those skilled in the art will recognize that the invention can be practiced with modification within the spirit and scope of the appended claims. Accordingly, the present invention should not be limited to the embodiments as described above, but should further include all modifications and equivalents thereof within the spirit and scope of the description provided herein.

SEQUENCE LISTING (16 sequences)

SEQ ID NO: 1 - DNA, 1653 bp, Homo sapiens
atgctgcgctccacgtccacggtcaccctgctctcgggcggcgccgccaggacgcccggggcgcccagcaggagggcaaatgtttgcagactacggctgaccgtacctcctgagagtccagttcctgagcaatgtgaaaagaagattgagagaaaagagcagcttcttgacctgagcaatggagaacctaccaggaaacttcctcagggtgttgtttatggtgtggtgcgaagatcagatcaaaatcagcagaaagaaatggtggtgtatgggtggtccaccagtcagctgaaagaagagatgaactacatcaaagatgtgagagccactttggaaaaggtgagaaagcgaatgtatggagactatgatgagatgagacagaagattcgacagctcacccaggaactatcagtttcccatgctcagcaggagtatctggagaatcacatccaaacccagtcgtctgccctggatcgttttaatgccatgaactcagccttggcatcagattccattggcctgcagaaaaccctcgtggatgtgactttggaaaacagcaacattaaggatcaaatcagaaatctgcagcagacgtatgaagcatccatggacaagctgagggaaaagcagaggcagttggaggtagcgcaagttgaaaaccagctgctaaaaatgaaggtggaatcgtcccaagaagccaatgctgaggtgatgcgagagatgaccaagaagctgtacagccagtatgaggagaagctgcaggaagaacagaggaagcacagtgctgagaaggaggctcttttggaagaaaccaatagttttctgaaagcgattgaagaagccaataaaaagatgcaagcagcagagatcagcctagaggagaaagaccagaggatcggggagctggacaggctgattgagcgcatggaaaaggaacgtcatcaactgcaacttcaactcctagaacatgaaacagaaatgtctggggagttaactgattctgacaaggaaaggtatcagcagttggaggaggcatcagccagcctccgtgagcggatcagacacctagatgacatggtgcattgccagcagaagaaagtcaagcagatggtcgaggagattgaatcattaaagaaaaagttgcaacagaaacagctcttaatactgcagcttttagaaaagatatctttcttagaaggagagaataatgaactacaaagcaggttggactatttaacagaaacccaggccaagaccgaagtggaaaccagagagataggagtgggctgtgatcttctacccaggttaccttttcgacaaaatgattcatctagtcattgccagaagagtgggtctcctatttcctcagaagagcggcggcgcagggataagcagcatcttgatgacatcacagcagctcggcttctaccacttcaccatatgcccacgcagctgctctccatagaagaatccttggcacttcagaaacagcagaaacagaattatgaggagatgcaagcaaagctcgcagcgcaaaaattagctgaaagactgaatattaaaatgcggagttataatccagaaggggagtcttcagggagataccgagaagtaagggatgaagatgacgattggtcctctgatgaattctga

SEQ ID NO: 2 - DNA, 1956 bp, Homo sapiens
atgcccagctcgctcggccagcccgacggcggcgggggcgggggcggcggcggcggcggcgtgggggcggcgggggaggaccccggacccggacctgcgcccccgcccgagggcgcccaggaggccgcgcccgcgccccggccgccgcccgaacccgacgacgcggccgccgcgctccgcctggcgctggaccagctgtcggcgctcgggctggggggcgctggcgacacggacgaggagggggcggccggggacggcgcagcggcggcggggggcgcggacggcggggcggctccggagcctgtgccccccgacggacctgaggccggcgcgcccccgaccctggcccccgccgtggcccccgggtcgctgccgctgctggaccccaacgcgagtcccccgccgccgccgccgccccggccgtcgccccccgacgtgttcgcgggcttcgcgccccaccccgcggccctggggcccccgacgctgctggccgaccagatgagcgtgatcggcagccgcaagaaaagcgtcaacatgaccgagtgcgtcccggtgcccagctccgagcacgtcgccgagatcgtgggtcgccagggctgcaagatcaaggccctgcgggccaagacaaacacctacatcaagaccccagtgcggggcgaggagccggtcttcatcgtgaccggccggaaggaggacgtggagatggccaagcgtgagatcctgtcggcggccgaacacttctccatcatccgcgccacgcgcagcaaggccgggggtctgcccggcgccgcccagggcccgcccaaccttcccggacagaccaccatccaggtgcgcgtgccctaccgggtggtggggctggtggtggggcccaagggcgccaccatcaagcgcatccagcagcggacgcacacctacatcgtgacgcccgggcgcgacaaggagccggtgttcgcggtcactgggatgcccgagaacgtggaccgcgcgcgcgaggagatcgaggcgcacatcacgctgcgcactggcgccttcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcatatcttttcctag

SEQ ID NO: 3 - DNA, 54083 bp, Homo sapiens
aggctggaaagtggaggatccggtttgctctgggcgggtctggaagcagagccggcggagggagcgccggggccctgggctgcaggaggttgcggcggccgcggcagcatggtggtgccggagaaggagcaggtgagcgccggaccagggtctgcgggagcgcggagctggggacctcgcctccaggctcccagagaggagggcgctggacacccagattcctgggtcagacggaggagggggatgggagggtccaggttccagggtccagggcatgggggtcgagactcctgagtctggagcgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagagggtccgcggcccgctgaccccgcccgcggatggtcacgccccagccctgctccttccccattcctggactcggggaccttcccaagggcgttccttgccgacgctctccctctaggagcgtttgggtctgtgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgggcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagtttttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttggtcttgaactcttgatctcaggcaatgcacctgccttggctttccaaagtactgggattacaggtgtgagccaccgcgcccagccctctagttgtttttcaagacagtttttggggtgcgggaagtatccacattcctacttcagtgtgtattttgttatgactatatattagtgcagtatggcttgtaaatgatggataaataaacagatatgcgcttgttggacgtgagtgctcaaaacctttttactgataggtcagtgtggtcaagacaatttaggaaactctggtctggcctgaggaggaagaaacgcagaagataattatagtaaggcaaggggttgcagctcccaaagacgagccactgggctctgtgagagctgggaggaggtgtttgcttaagactgggaggggacacaaaatgtcactaatggtttctggagggaggaagagtggctagtgaggtgacatttgaaagtgagctggagagaggcccatggaaagcgatttggggccgggcattgtggctcacgcctgtcatcccaacaatctgggaggccgaggcgggtggatcacctaagtcaggagttcgagaccagcttggctaacatggtgcaaccctatctctactaaaaatacaaaaattaactgggcgtattggcgcatgcctgtaatcccagctactcaggaggcaggagaatcacttaaacctgggagacggaggctactatgagcagagatcacgtcactgcactccagcctgggtgacagagcaagactccatctcaaaaaaaaaaaaaaaaagaaagaaagaaagaaaaaagtgatttgaacagcatgtgcaaagtccttgctaaggaccatatggtttggcttgaatatgaatcaaagttcagggtgcagggagcactgtcatgagagaagaggctgcagaggagggcagggccagagcttgcagggtgtcagaggccaccctaaggggctgggatcttgtccttgggagctggggcatcaccgcagcagtggggttggctctgggtgtggaaaaactttctggggctgggagaggatgaacaggagctcgggaggaggctgtagagagcgtctgagcgggaggggtagtggcctgagccaggtcagggctttcgggacacagagaggagggcatggggcaaagactcagggggcaggaaggcagagcttggggcttgatgagggtgatgagggagagagggggtgccgccatcggtggatggctccgggacgtatgctctgctgactgggacacagtggggctgtccctgagatggagagctcaggagggcaagcaggtttgggaaatgtcgctgagtgcaatgtgggaatctgtgcatatgagcggcctagggggaccgaggggcatgtggggactgagattgggaaaggtctggactaatgtccagaatctgagaggtccgagttgtagctggtaattgaaactggaagtaggtaagacgtcacagggaaaacaacgtgtaaagtcaggggagttgcaaactggcaattctatagccaattgtgtgcgtgtgtttgtgtgtgtgtgtgtttagaagagcatttaaaaatatctgtcttctgtctctctctcttttttttttttttttttttttgagacagggtcttgctctgttgtccaggctggagtggcacgatcatggttcactgcagccttgacctgctgggctcaagcgatcctcccacatgagcctccggagtagctgggaccacaggcatgcaccaccatgcctggctaattttaaaattttttgtagaaaccgggtctccctttgataccagaccaggctggtatccaactcctggactcaagtgagcctcccacctcactctgcctgccaaagtgctggaattacaggcgagagccaccatacccggctacctcttttttttttttgagacggagtctcgctctatcacccaggctggagtgcagtagtgcgatctcggctcacttcaacctctgcctcctgggttcaagcgattctcctgcctcagccccccgagtagctgggattacaggcacccaccatcacgcctggctaatttttgtacttttagtagagacaaggtttcaccatgttggccaggctgatctcgaactcctgacctcaagtgatctgcccacctgggcctcccaacgtgctgggattacaggtgtgagccactgctcctggccctggctacttctttctgttgagttacttgactggcctctgcacacattgggtttgagaatcatgtagggaaggcttgcactgggaacacctacactcaagggaggtgaaaagcaagagaaagccacaaacaagtcaggcatgaagcagccggggcggggaggaaggccagaggggcaggggtatcctgccaaggagagggtttccagaatgagagcctttcagctgtagccagggccacttgtgatacagtcagatgaaacctgaataagggccgttgtatatggagccaggcaggaaattgatgatttttatcaagaacaatttcaggccaggcacagtgactcacagctgtaatcccagcagtttgagaggccgaggtgggctgatcacttgaggtcaggagtttgagaccagcctggccaatgtggtaaaaccccatctctactaaaaatacaaaaactagccaggtactgtggcacatgcctgtaatcccagctactcaggatgctgaggcacgagagtcgcttgagcccaggtggcagaggttgcagtgagctgagatcgtaccactgcattctagcctgggagacagagcgagactccatctcaaaacaaaacaaaacaaacaaacaaacaaaaaaacaatttatttcagtttctgtggctccaccgaggaaagagtgtaggaggcaagctgtgcagaaggaatggctcctagcactgaatgtcagaattttccacgattttggaaacgttctatgtctacatccaatatggcagtcctggccacagggggctactgggcacttggaatatggccattgtacctgagaaactgaatttttttttgaggtggagtctcgctctgtcgcccaggctggagtgcagtggtgcaatcttggctcactgcaacctccgcctcccgggttcatgccattctcctgcctcagcctcccgagtagctgggactacaggcacccgccaccatgccaagctgatttttgtatttttagtagaaacagggtttcaccatgttggccaggctggtctcaaagtcctgacctcaggtgatccgcccaccttggcctccctaagttctgggattacaggcatgaaccactgcacttgacctgaattttttatttgatttaattttaacttattagaacagaaagagctccatggctacaaagaacccatgcagctatcacattggacagtacaagctccagactattccgtgaagagcttttattttattattattatttttttttttttttgaggcagagtctcattctgttgcccaggctggagtgcagtggcacaatctctgctcatcacaacctccgtctcccaggttcaagtgattctcctgcctcagcctcctgagtagctgggactacaggcgcgtaccaccatgcccggctaatttttgtatttttagtagagataaggtttcactatgttggccaggctggtctcgaactcctgacctcatgatccgcccgccttggcctcccaaagtgctgggattacagtcatgagccaccatgcccggccttatttcttatttttagtgacatggtcttgctctgttgcctagcctgaactgcagtggtgtgatcatggcttattgcagccttgaactcctgagctcaagtgatcctcctgctacagcctcctgagtagctggaaccacaggcgtgcaccaccacacctggctaattaaaacaattttttttgtagggatggggtctcgctctattgcccaggctgttctcaaactcctgggctcaagcagtccttctgccttgacctcccaaagtgcttggattgtgcccagccgtccttgaagttttgctcagaagagcaaactttctgggaagtagctgcaggtgttggaagtagctgcaggggaactaggggattcaaggatggagctgaaatgggtgaacggacaaagtcggtaaactgaggcatgccagggccctggaggtagactcaggaatgaagaagacactttattgtagttctcactgtgccaggacctggcctaagtgtgtttggttcatcccatgtgtggatcagttagccgttcttttagtgtctttacggcttttgccaaatccttgtagcacctctgctatcccttctgtaaaattgctcttaaatctgctcactaggtttgtgtaaatacaggtctcccctgatatctgaactcctggaatctggaacaaagaatttagatacatttttctccttctttcttcctttctctttcttttcttttcttttctctctctctttctttctttctctctttctctttctttctctctctttccctccctccctccctcccttccttccttccttcctttccttcctccctctctgtctctctccctccctccttcctttctttccttagttttttttttttttttttttttttttttttttttgagatggagtttcgctcttgtctcccaggctggagtacaatagtgtgatggctcactgcaacttctgcctcctgggttcaaccaattctcctgcctcagccttctgagtagctgggattacaggcacccgccaccacgaccagctaatttttgtattttttttagtacagacagtgtttcaccatgttggccagtctggtctcaaactcttgacctcagatgatccacccgcctcagcctcccaaagtgctgggattacaggcatgagccactgcgcccggcctcttgcttgcttgcttgcttgcttgcttgcttgcttgcttgcttttctttccttcttttcttttttttgaacagggtctcactctgttgcccaggttggagtgcagtggcgtggtcacagctctctgcatcactgcagccttgatctcccaggctgaagtgatcctcctgcctcagcctcctaagcacatgctgccacacctggctaattttattttattttattttatttatttatttatttttagagacagggtctgactatattgcacagctggtctcgaactcctgggttcaggtgatcctctggccccagcctcccaaagtgctaggattacaggcatgagccatcatacccgaccctacattttcaaatgaatttctcattctccaaacccctgttacttactcaggtgccaatcacctttagaaagcaagagagacttgtgcatttctttaggtgggggaaagttttatatgtggaaactttccaaatggaaacctgttccatttggcacagagaggaagaaacaagccacacagaagccaaagacaatgaaaagcaaacaaaggtgtttccctactcgctagatggctgttgccagctccattttttgagcccgaggcctgcttttcttgttcaaaagagtagcaaagggttaggcattcaaaaatattctagcacccggctgagcctctctccttgacagtcgtcaggagaactgaaaaaggaatgactttctcactgcgttattcaaggttattttaagctccgtgtgaagttcgtgtcgcgttgcctctggctgggactggtatgcgagcctcatttcaggaaacacggcgttctttccctggctcctcatagctccgtggagtaggccgcgctattattgtcttttcattagaggaggaaatttaggctcagagaggtgaagccgctcgcccaaagtcacacagccgcgtcagccccgagcatgcgggctctccctgagttacccgctggatgttctttctcgtgttgaacgtcatgtgtttggatgggggcacagggcacagcaaggatacccccagtggccctctgccttcccacttgaggctcctcaggtgacagtgacctgcttcttcctgctcaggctttctggactcactggcttccttcccgtggggaaaggggaccgtcctcggctccagtctctccccgaggccgtcagagccagggccaggggcagcgtggactctgcctgcctctgtgggtgtggactcagtgtcgacagccccctctacaggagcatgaacacgctgacagggtgctggggtcggggggcagccctgggttcacgctccgccctcgcacccccagagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccgtctctccgggtctctgtttccccttttctgtgggtcactgtcctcatctctttgggtctgtgtttccgcttttctctgtgtctctgtccccgtctctctgggtctctgtctctgtctctctgggtctctgtctctgtctctctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctgtcgccatctctctgggtctctgtccctctctctctgggtctctgtccctctctctctgggtctttgtccccgtctctctgggtctctgtccccgtctctctgggtctctgtccctctctctctgggtctctgtcccatctctctgggtctctgtcccatgtctctgggtctctgtccctctctctctgggtctctgtcccatgtctctgggtctctgtccctctctctctgggtctctgtccccatctctctgggtctctgtccctctctctctgggtctctgtccctctctctctgggtctctgtccccatctctctgggtctctgtccctctctctctgggtctctgtccccgtctctctgggtctctgtccccgtctctctgggtctctgtccccgtctctctgggtctctgtccccctccctgtgtgccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggtgaccgagggtgggtgggggctgtctcctgggcctcggcctgcctgccatctcccccacgactgtgggtggcctcccccgccgcccagtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacccacaacccacgacccacaacctgcaaccccagcgctcaggatcccagtagtttggtctggtcgagatttggggaattacctatggttaagtgtctttccccgtcattattcatggttttaaaaacttctgtctgagagtgagttagctcacatcagtaatcccaacactttgggaggccgaggtaggaggattgcttgaggccagtaattcaagaccagcctgggtaacagagcaagaccttgtctctaccaataataataataataataataataaagaataaaaaataaattagccaggtgtggtgtcgtgtgcctgtaatcccagctacttgggaggctaaggtgagagaactgcttgaacccgggaggtggaggttgcagtgagccgagatcaagccactgcactccagcctgggcgacaaagcaatactccatctcaaacaaacaaacagactttattttgaaatttctcatacatacagaaaaatgcacgaaggtggacagcttgatgcatttttttctttttttgagacggagttttgccctgttgcccaggctggagtgcagtggcgcgatctcggctcactgcagcctctgcctcctgggttcaagcaattctcctgcctcagcctcctgcctcagactcctgagtagctgggattacaggcacgtgccatcacacccggctaatttttgtatttttagtagacggggtttcaccgtgttagccaggatggtcttgatctcctgaccttgtgatctgcctgctttggcctcccgaagtgctgggattacaggtgtgagccaccgcgcccggcctaatgtttgtatttttagtagagatgaggtttcaccttgttggctaggctgttttcgaacttctgacctcaagtgattcgcccacctcagcctcccaaagtgctaggattacagacgtgagccactgcacctggctccggctaatttttaaagttttttgtagagacagggttttgccatgcagcccaggtggcctcaaactcgtggtcgaaagtggtccacctgcctcagcctcccaaagtgctgggattacggtcgtgagccactgcgcccagccagccaatatcttataattttatcaaaacatgaacaagatacattactaggtttgaggaaagtttttgatttttgtgtatttttcttgtatcaatcctcttaccaaattttcttattgatctttatttttatttttggtggggttttccaattttctgggaatacaagccatgttttcttcaaataggtacttttgtcccttccagctttacaaaaaaccaaaaaccaaaaaatcaattttcacttcagtgatttcatttttttgcattattgagttagctcaaaactccaggatgaatacagtgttagtggtaatgtggtctagtttctaatttatttatttatttttttgagagggagtcctgctctgtgcacaggctggagtgcagtggcgtgatctcagctcactgcaacttctgcctcctaggttcaagcgtttttcctgcctcagcctcccgagtagctgggactataggcacgagccaccactcccagctaatttttgtatttttggtagagacggggtttcaccatgttggccaggctggtcttgaactcttgacctcaggtgatccacccgcctcggcctcccaaagtgctgggattacaggcatgagccaccgcacctggcctagtttctaattttaatggaagtagagtcgatatagtgctatctttatggtgcaattggattttggtaaatatctatattgtggttagatagccctttctattcccatttcctttactttctatttgaactttcactccctctggctcctggatggttaatcaatgacaggattgactcatacaagaaacacctgcctcattcagggactcaggagtctaggtcctcagccccctcctccctggggaagttaagcattactgtcttcaaaatctagctccctcctgaagtgtccaaagacatgacaattctggccaggcgcgctggctcacagctgtaatcccagcactttgggaggccaaggtgggaggatcccttgagtccaggaattcgagaccagcctgggcaagatggcaagacccctgtctctaccaaaaattaaaaagttagctgggcacggtggtgtgtgcctgtggtcccagctacttagaaggctaaagtaggaggatcaagatgtagtgaggtgtgatcatgcccctgcactctatcctgggcgatagagtgacaccctgtttcagaaattaggctgatgcggtggctcatgcctataatcccagcactttgggagtccaagttgggaggattgcttgaggccaggagttcgagaccaccctggccaacatagcaagacccccatttctaaaataaatacataattaagtaaaaaaagaaatgacaattccaatgagcctctgaacagaagattaggacaaggctgatgtttgccgactcctgggaaatgcggttttctcctatctccagcaaaggctgatgggaggtaatcaagcccccttctcttcttgcctcagggactggaattgacatccctgtcctgctcctcctgattgatggtgatgagaagatgttgacggtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtagcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtatgacactgggggcccaactctggatcctgagatgggagggaactggggacttgggctcctgggtctgagggaggaggggctgggggcctggacttccaggttccgggagaagagggtgctgggcatatagactattaggtcctggaggggaatggcctcctccatccctttggacagggcccaacaggagttggggatggaggcgggctagggatgcagaactggctattccacaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacacatccactgacaattccattcagtcattcttccatccatccatcttctcacctgtccatccatgcatccactgacaattcctgagaatgccatctgctcattcttccatccatccatcttctcacctgtccatctacacatccaccgaaaattcctgagaattccatccactcattcctccatccatccatcttctcacctgtccatccacacatccactgacaattccattcactcattcttccatccatccatcttctcacctgtccatccacacatccactgacaattcctgagaatgccatccgctcattcctccatccgtcttctcacctgtccatccacacatccactgacaattcctgagaattccatccgctcattcctccatccgtcttctcacctgtccatccacacatccactgacaattccatccacttattgttccatccatccatcttctcacctgtccatccacacatccactgaaaattccattcactcattcttccatccatccatcttctcacctgtccatccacacatccactgacaattccattcacttattcttccatccatccatcttctcacctgtccatccatgcatccactgacaattcctgagaatgccatctgctcattcttctatccatccatcttctcacctgtccatctgcacatccactgaaaattcctgagaattccatctactcattcctccatccatccatcttctcacctgtccatccacacatccactgacaattcctgagaattccatccgctcattcctccatccatccatcttctcacctgtccatccacacatccactgacaattccattcactcattcctccatccacccatcttccatccatttacccatctacccatccatcttttcattcatccatccaactgttcttccatctatccatccacccacccattcttccttccctacatgcttccaatatacatgaagcactctggctagacatgaaccaaagcactgtctcccagtgaggaagtccagatatttcactagaaatggcagcttggaggacggaatgatgaaaaccaaggcgggggagcataatgcacacctgggagaggctggggagggtcttatttatttattcacttattgagacagggtcttgctctgtaggccaagctggagtatagtggtgtgatcacggctcagtgcagcctcaacctcccaggctcaagtgatcctcccaccccagccttccaagtagctgggaacatacccgcccaccactacacctggtaaattaaacaaaaaaaaaattttttttttgtacagacgaggtcttgctctgttgcccatgctggtcatgaactcctggcctcaactgatcctcctgcctcagtctcccaaagtgctgggattacaggcatgagccaccatgccagcctcctttatttagtcaacaaatacaatcctaggctccagagactaaagccaacccatttcctgctctcaaagaccccagatcccactaggattgtttggatacaaccttaggtaaaatttaagacagaagcacaggcaagaatcactgtcgttagaaggaaaacttcaaggaaaagttgtgtgtgtgtgtgtgtgtgtattttgagacagagtcttgctctgtcgcccaggctggagtgcagtggtgcgagcttggctcactgcaacctccgcctcccgggttcaagcgattctcctgcctcaccctcctgagtagccgggattacaggcacgtgccatcatgcccggctgatttttgtatttttagtagagacggtgtttcaccatgttggtcaggctggcctcgaactcctgacctcatgatccatccacctcggcctcccaaagtgctgggattacaggtgtgagccactgcacctggccagagaagttggcatttaaaccggaccttggccaggcacagtggctcacacgtgtaatttcagcactttgggaggctgaggagggaagatcgcttgagcccaggagtttgagaccagcctgggcagcatggtgaaatgccacctctataaaaaatacaaataataagttggggagggtggcgcatacctgtaatcccagctacttgggtggctgaggcaggggaatcgctcgaacctaggaggcagattgtgccactgcactccagcctgggtgatagggcaagactctgtctcaaaaaaaaaaaaaaaaaacctaaataaataaaccaaataaactggaccttgataagtcagtagaatttggatttagtaagctaacgagtgggacagataagtattcaggaagattcccagggctctgtgtggggagggtcatttttggtgtcagaagaacttttttctttttttttttgagataaggcctcgctctgttgctcaggctggagtgcagtggtgtgatcttgacccactacagtcttgacctcctgggctcaagagatcctctcacctcagccccacaagtagctgggaccacaggcatgtgccatcatgcctggctttttttttttttttttttttttttgagacggagtttcgctcttgttgtccaggctggagtgcaatagtgccatctcagctcactgcaacctccgcctcccgggctcaagtgattctcctgcctcagcctcccaagtagctgggattacaggcatgcgccaccacacctggctaattttgtagttttagtagagatggggtttctccatattggtcaggctggtctcgaactcccgacctcgggtgatccgcccgcctcggcctcccaaagtgctgggattacaggcatgagccactgtgcccagccttttttgtatttttagtagagatggggtttcactatgttgcccaggctggtctcgaactcctgggctaaagctatctgcccatctcggcctcccaacgtgctgggattacaggcgtgagccattgtgcttaggccagaagaattttacgggggaaatacacactaagatagaaactccccagatacacggtggcaatatatacagcattctacctcagctccccacccatgtttgtggtgtggtatatattttaattatttttcttattttaattatttctttctttttcttttttttttttttgagacagagtctcgctctgtcgcccaggctggagtgcagtggcgcgatctcggctcgctgaaagctctgcctcctgggttcacgccattctcctccctcagcctcccgagtagttgggctctctatttttagtagagacggagtttcaccgtgttagccaggatggtctcgatctcctgaccttgtgatccacccgcctcggcctcccaaagtgctgggattacaggcgtgagccacggcgcccggcctcttttttttttttttttaaagagtctttgtctgtcgcccaggctggagtgcaatggcgccatctcagctcactgcaacctcctcctcccaggtttaagcgattctcctgcctcagcctcctgagtagctgggattacaggtgcccacaaccgcacccggctaatttttgtatttttagtacagacagggtttcgccatgttggccaggctggttttgaactcctgacctcaggtgatccacccgcctcggcctcccaaagtacttggattacaggtgtgagccaccgcgcccggccttaattcatttttaggtattttttgagacagtctcactctgttgtccaggctggagtgcagtgggacaatcatagctcactgcagccttgagatcctgggctcaagtgattctctcgcatcagcctctgagtagctgtgcgccaccacaccaggctaatttatttttaatttttttatagggatagggtctccctatgttgcctgggctggtcttgaactcttgggctgaagagatcctcctgccttgacctcccaaagtgctaggtatagtacaggctgtggtagggtagaaagagcaagttatttttgctttggaatcagacaaaactgaatttaaataccagcttgggccgggtacagtggctcacgcctataatcccaacattttgggaggctgaggtaggatcacttgaggtcaggagttcgagatcagcctggccaccatggcaaaaccctgtctctactgaaaatacaaaaattagctggcgtggtggcgggtgcctgtaatcccaactagttgggaggctgaggcaggagaatcgcttgaacccaggaggtggaggttgccgtgagccaagatcgtgccactgcactccagcctgggcgacagagcgagactctgtctcaaaaacaaacaatcaaaaagaaacaaaccagcttggccctttcttgctgtgtggtcttgaggaagcagcttcccctctctgagccccagtttctctctgtggaaagtggagataatatcttacaggagtgttataagcctccatggcaaggtatgagttgtgcccggtcccggtgggggcccaataagagggatctcctcttaatatgattccatttcctctgggggtacatccttcaatataaggtaactctcagtgggcaaatctgattcactctgcggaagttaactcagcagcctcctgggagaaaatacggcagctctgcaagatgtggtttgagggggtggtgttgtaagcccagcaggagtggaagtgatcacagtccactgggggaactggagatggctgataggcttggggatagcagagttgaatggatggaatttcagcaagaaagaagggcaaggtcatgaatgcgtcttttttttttttttttttttttgagacagtgtctcgctctgtcgcccaggctggagtgcagtggtgtgatctcagctcactgcaacccccgggttcaagcgattgtcctgcctcagcctcccgagaagctgggactacaggcacctgccactatgcctggctaatgtttgtatttttagtagagatggggtttcaccatgttggccaggatggtctcgaccttctgacctcgtgatctgcctgcctcggcctcccaaagtgctgggattacaggtgtgagccaccacccctggcccatgaatccttcctaagagtctagcataggcaggcccagtgctgggcagttggtgtactcttttgcccttcatctcccttccctgcctgcaaggattatcaccccattttgcagatgaagagactgaggctcagagagaggaaaaatggcttgcccagggtcatccagctagtagcaggggtcaggcttttcatgtgagtctgtataattctcaagcccattgcaaggggcatgtttggagagaggtcagaggctcgcagggttggtatgtatcattggcatgaagggagtgttggagacaaggccagtgaggcaggtagggccaaaccacccaggacctcaaatgccaggcagaggggctaaggctgtccttgagaggcagcagaggaccagggtccgttatgtggataaaaaagactctctggccaagcgtgaaggctcatgcctattatcacagcaccttggaagactaaggaaggaggttcgcttgagcccaggagtttgagaccagcctgggcagcatagtgagaccccatgtctataaaaaattagctgggtatggtactgtgcgcctgtagtcccagctactcgggaggctgaggcaggaggatcgcttgagcctgggaggtctcaaagctgaagtgagctgtgatggcgccactgcactccagactgggtgacagacgaagaccctgtctcaaaaaacaaaaacagactctctgggagtgggtgggggcagagtggagaggagagaagagactgcagtgatggtgtttgggggtgccgaagcttgagctatagctggggccaggaggacagtcggggaggctcagcagagagtcaggaggctggacgtgggacatgaagcttgggggctgatggcctgtgagatgggaggagcaggaagggacaaggacagtacctgcgggtctgccttattgattgggtggacagaggggccattcctgagatgaggacgtagggaagatgggtttgagggctagatgctgagttgagtatggaacacggtgagtctgaagggacaaggtggggccagggtcgagtgcccaggtgacaaatggtgccagattaaggcggaatataaagcaaggtattattattattattatttttatttttttattttttttgagatggagtcttgctctgtcgtccaggctggagtgcagtggcacgatcttggctcactacaagctccacctcccaggttcatgccatcctcctgcctcagcctcctgagtagctggcactacaggcgcccgccaccatgcccggctaattttttgtatatttagtagagatggggtttcactgtgttaaccagggtggtctcgatctcttgacctcatgatccacccatctcggcctcccaaagtgctgggattacaggtgtgagccactgtgcccggcctattattattatttttgcaacagagtttcgctctgttgcccaggctggagtgcaatggcgtgatcttggctcactgcaacctccacctcccgggttcaagcgattttcctgcctcagcctcccaagtagctgggattacaggcatgagccaccacgcccagctaattttgtatttttagcagagacgaggtttctccatgttggtcaggctggtctcgaactcctgacctcaggtgattcgcccacctcggcctcccaaggtgttgggattacaggcatgagccacagcatccagcctattattattatttgagacggagtctccctttctcacccaggctggaatgcagtgacgtgatctcggctcactgcaacctccacctcccgggttcaagcgattctcctgctcagcctcccaagtagctgggactacagacgcatgccaccatgcccagctaattttttgtattttagtagagatggggtttcaccgtgttacccaggctggtctcgaactcctgagctcaggcgatccgcccatcttggcctcccaaagtgctgggattacaggcgtgagccacggcgcccggcctgtaaagcaagatattatgaacaattttgtttccttcttttgaaactgtggggaaagtaggagagcttcatagaatcgtagaaagtcgtggaaaagtccgctctgaatggacgtctgggttttgaaagagcacagaaagccatgaggtcctagacatgttactgcctttctgggcctctgtttcctcaagcacagccttggaggttacactggccaagctgtagtgtcgccacagcgtggaacttcttcccacagttactgtaattgattacagtgctatgaagggggtgccactatttcccatttaatagatgaggaaactgaggctcccaaggttcaatggcttgcctgaagtcactcagttggtactggtggaccggggactggaacccacgtctgcctgccccagagcctattgctcacctccactacatgagattatctctttctgtggtaccagtttttggagcaaccaaaatgagatgaatttgttttggagatagatatggagcaagtggaggcagaaggaaacctaactccatgtcacgacaaatgcccttcaggacttttcatgcccctgttgactgcacatgtttggatccactacatagctggatcaaatttttaagggtttctggttctctcttgctgtttcagtgacctccagggtctctcggagtccctctcctgttctcattttctgctgttgtcacctctttcccttcacaatataccccaagtttcagaaatcagagtgactcacgtttgtcatcatctgctgtgtgtgtgtgtgtgtgtgtgtgtgtgtgtgtgtgtgtgtgtgtgtgttgcacccgggcctttgcttctgctgtgcctgctgctttgaacgcccttttcgcaccttaggggcatacctcccagtcctggtggtctttcaaagtgctacctcaacacccattctctgggagctctcttgggccactctatacctctgtgaccatatcctcctctgggccctaatcatattatatgcctatagatgcctccttagacacccctccaccctgccttccattatggcctgtccagccttccctttaatcgcccatccatctctgattgtccgtctgccccatcttgtttcctctctccccatccatccgtctgtccatctatccatctatccaccctgtacatccatctatccatccatccgttcattcatccatctctttatcctttcatccatccatttatccatcccatccatccatccttctatctgtccatccatccatcctaatcatattatatgcctacctctgagggcaccaagcaccctgagggtagttatgtgttggggggacatatttcccccaatagaaccagcttcttcagggtaggaactgtatctgatttctctctccatccctcccactgcttggtccataacatacctcaataaatattaaatgaataagtgattccttttgtttcttcttgggggctgtaaaccagtggtctgtgctctggccctgagccaaatgaccttatgcctatgatagcctgactgctttaagacccccacactctgcccagtagcaacccctttatgcagagtttaaaagtcagacatgcaaaatagaggcaaaatagacattcagcagatgtccctcctcccctgacttcttgtcccctctccctctaatccttccagcctgtgggagctcggaggcctcagcctacctggatgagctgcgtttggctgtggcttggaaccgcgtggacattgcccagagtgaactctttcggggggacatccaatggcgggtgaggggtcagggcctgggggttgggcatactgacaaagggactgtgctgtcctccctctctgccttctttttttttttttttttttttgacggagtctcactctgtcacccagcctggagtgcagaggtgtgatcccagctcactgcaagctccgccacctgggttcacgccattctcctgcctcagcctcccgagtagctgggactacaggcgcccgccaccacacccagctaatttttttgtatttttagtagagacggggtttcactatgttagccaggatggtctcgatctcctgaccttgtgatccgcccgcctcaggctcccaaagtgctggggttacaggcatgagccaccgcacccggcctctctgccttcttagacgcccctcaaccctgccttccattatggcctgtccagccttcccttaattgtccatccatctctgtccatctgccccatcttgtttcctctctccccacccatccatctgtctatccatccatccaccctgtacctccatctatccattcatccattcattcatccatctacttatccatccatccatccatttgtccatccatccatttatccatccatccatccatccatccatccatccatctgtccatccatccatccatccatccatccatccatctgtccattcatccatccatccattcatctgtccatccatccatctacctatccattcatccatacatccatccatctacctatccattcatccatccatccatccatctatccatccatccatctgtccatccattcatctgtccatccatccatctacctatccgttcatccatccatccctctgtccatccatccatccctctgtccatccatccatccctctgtccatccatccatccatccatccatccatccatccatctgcccatccatccatctgtccatccatccatctacctatccattcatccatccatccacccatccatccatccatccatccatccatccatccatccatccatccatccgtccctcatacccttgcccatctcttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcgtaaggaccgggcaaagctggggggcccccccgcgcgggaaggacctgggggcgggattacatcagggatggggcgtggccaaaccagaggcagggctggtggtggccagtgttggggaggggctggtcctcaccacccctccttttgctggcagatgtatctgctctcggacaaggccacctcgccgctctcgctggatgctggcctcgggcaggccccctggagcgacctgcttctttgggcactgttgctgaacagggcacagatggccatgtacttctgggagatggtgagtgctgacttggcgctcctgcatccctgtcctttaggccactggatgccagtgttcccgaaacaattaccatacaattccccgacccctgacgtcacctgacaggcgccccatcctccgtcgctgatatatgcctccaactgcttcctctttcttttctctctctcacatcatgcattattttatgtgtttattttttgagacagagtctcgctctgtcgcccaggctgcagtgcagtggcgcaatcttggcttactgcaccctcagtctcccgggttcaagtaattctcctgcctcagcctccggagtagctgggattacaggcacctgcccccacgcctggctaatttttgttttgttttgttttgttttagtagagatggggtttcaccatgttggccaggctggactcctgacctcaagtgatccacccgcctcggcttcccaaaatgctgggattacaggcatgtgccaccgtgcctggccaagattctctctttgttttggcctttgataatatatctcagtgtggatctctgtgaatttctttttctttttcttttttttttttttttgagatggagtcctgctctgttgcccaggctggagtgcagtggcatgatctcggctcactgcaagctccaccttctgggttcatgccattctcctgcctcagcctcccgagtagctgggactacaggcgcccgccaccacgcccagctaattttttgtatttttagtagagatggggtttcaccgtggtcttgatctcctgaccttgtgatctgtctgccttggcctcccgaagtgctgggattacaggcgtgagccactgtgcttggcctgtgaatttcttttacttggagttccttgagcttcctggatgtgtagacttttgtctttcatcacattttggaagtttttaggacattatatcttcaaatattatttctttccctttctgtctctcttttccttttggactctcattatgtatgtattaatattctgtatggtgtctcgcaagtcccttaggctctgcttattttccttcatttgtttttcttttttctcctcaggctggataatctcaatgtacttagcttcaaattcactgatctttattttgccttttttatgaatctactgttgagtccctctagtggtttttatatttcagttattgtgctttttagcttcagagtttctatttggttcatttctgtctctgtagtcttttttttttttttttttttttttttgagacagagtctcgctcagtcgcccaggctggagtgcagtggctcaatctccgctcactgcaagctctgcctcctgggttcacgccattctcctgcctccacgccattctcctgcctcagcctcccaagtagctgggactacaggtgcccgccaccacgcccagctaatttttttgtatttttttagagacagggtttcactgtgttagccaggatggttgcgatctcctgacctcgtgatctgccctcctcggcctcccaaagtgctgggattacaggcgtgagccactgcgcccggcctctgtagtctgtcttttttttttcctggtcccactacaaaactttatttttgattacagtaccattctcaatctcttctacaaaaagcagaaaaaaaagcagccacttcactcaagacctatatacagataagatgttttctgtgtttttttcttttttttttaatttttatttttaaaaaaataaattcagtgttcacatttctataaagaattaacccagtttcaggaaaccctgcctctatctctgtattcttattctctaggtggtgagacatctttttcctggctccctttagttcttttttcatgatttcctttagctcttcgagcatatttaagacaatttatttaaagcctttgctagtaagttcagtgtctgagtttcctcagggatagtttctattcatttatttttttcctactcatttctattcatttcatttcttttcttttatttatttatttgttgttcttgttgttgttgttgagacagagtctcattctgtcactcagactggactgcagtggtttgaccaaagttcactgcaaccttgacttcttggactcaagcaatcctcccacctcagcctcctgagtagttgggtctaccagccacatgccaagctaattttaaaaaatttgcagagatggggtcttactatgttgcccaggttggtcttgaattcttgggctcaagcaatcctcctgcctgggcctcccaaagtgctgggattacaggtgtgagccaccatgcctggtctctattaatttcttttttttccagtatatgaaccatattgtcttgtttctttgcatgcctcataatttttggttgaaaagtggaacattttgaatatgataatgtggcaactctggaaatcagcttatgccctccctccagggtttgttgtggctgctgctcattgtgggtcattgttgtttgtttagtgacttttcttttttctttttcttttttttggggggaggggggatggagtctcactctgtggcccaggctagagtacagtggtgcaatctcggctcactgcaagctccacctcccaggtttaagtgattctcctgcctcagcctcccaagtagctgggattacaggtgtgtgccaccacacccagctaatttttgtatttttcatagagacggggtttcaccatgttagccaggctggtctcaaactcctgacctcaggtgatccacccaccttggcctcccaaagtgttaggattacaggcgtgagccaccgcgcccaccctgtttagtgacttctctaaaccttttttggaaagtctgtattctttgcatgtgtggccatggaagcccctcttctgttagcttagtggtctgctggtgacttgacagagatatccttaaatgcctagaaccacagaagcaaatataacaagaaactccctataagtgctgggattagaggcatgagcgacgcccaccgtggctgtatattgaagcagtctttcaatacttagccaagctgtttacagttctgctttagtcttcacttcctgcttgtgcagagcctaaagttcagccagatgtaagagcttcaggttttctctggtattttctgagcacgcctctagccctagtcatgcatctagccgtctggatttcctggtacacaaggaagactttcaaagcccttattccctccaagtatttcctttcatggcctctttcttcccaagatgcttagtgtatctattactgcctctactgtgagtccttgcctcagatggatgtggttaattcatttgcctttaaaagattttaacaggccgggtgcagtggctcacacctgtaatcccagcactttgggaggccgaggcaggtggatcgcctgaggtcaggagttcgagaccagcctgaccaacatggagaaaccctatctctactaaaagcacaaaaaattagcctggcatggtggcgcatatctgtaattccagctactcgggaggctgaggcaggagaattgcttgaacctcggaggcagaggttgtggtgggctgagattgcagcattgcactccagcctgggcaacaagagtgaaactccgtctcaaaaaaaaaaaaaaagattttaacacacactgcctggaaagccactttttctctggggaaagctctaaggcaggtgaagcaaagtcaagtccttgagctgttgcttcagggagccaccagatagggccacacacacaaccacaattctggagggtaagtctgaattgctccctctagtactagcgacccacaccaggaatgtgtgtctttgtcttcaaggttgccactgaactggggagctgggggtagtaagtgggtaggttaaaatgtcacagtaccctcttactgaaatttagtggtctcttcattaagcattttcttgtttttttttttttataagttttcgattagattccagaattctagaaaagttgattctgacaacttttgatagctattgattgcttttgtggagggataaagttttgaagttccctacactggcatttttggtcacctctccaagggcttttaaaaatttcattgttagagacagggtcttcctcagtcatccaggctggagtgcagtggcatgatcatggctcactgcagcctcaacctactgggctcattcgatcctcctacctcagcttccctagtagctgggactacagaagcagaccaccacgcctggctaactaaaaaaaaaaaaattttgtagagatggagtctcaccatgttgcctggctggtcttgaattcctgggctcaagcaatcctcctcatttgtaaccacccaatgggttcacgttgcccgctgcctagacagagccgatttatcaaaacaaggaaagtgtaatggagaaagagtaattcgcgcagagccggctgtgcgggagacctcagttttattatcactcaaatcagtctcctcgaggattcagggatcagagcttttaaagataatttggtgggtagaggcttgggaagtggggagtgctgattggtcaggttggagatggaatcacaggggttggaagtgaggtttttcttgctgttttctgttcctgggtgggatggcagaactggttgagccagactacagtctgggtggtgtcagctgatccatccagtgcagggtctgcaaactatctcaagcactcatcttaggtgttacagtaatgatgttatccccaggagcaattgggggagccagaggctgcgtgacccctaaacttaatttctaatcttgtagctaatttgttagtcctgcaaaggtagactggtccccaggcaagatgggggtctttggggaaagggctattatcaatttcgtttcagagtcaaaccatgaacagaattccttcccaaagttagttcagcctatgcccaggaatgagcgaggacagcttaagggttagaagcaagatggagtcggttaggtctgatttctttcattgtcataattttctcagttatcatttttgcaaaggtggtttcacttcagcctcccaacgtgctgggattatagtcgtgagccactttacccagcctccaactgcttcttgacctgtctgtgactgctgaattgattctaactgcagcccagcccctgacttgcatccctggtctctgaaccacctgacttctggcattttcaactgactttcagtttcttccagatccatctccaaacattacttcatccttggcctctgatgaccccagttagtttctgacctctgactctgttccttcccttgacttcaggcttcctccccctctatgaaccctctttgacgcatccgtgccctctttgtctctccagggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacaggtgagtatctgcgacaccaacatcccaaacagtctccaagtggactctgggaagtatggggatgagcccctgccattgggaacatctatggtcttgaccagccactctccctggagatcccccagaaagtctctcttctctctcagaaaggctgctcttcccataagaagccccgctcccttccaccaaaagccaaccttcccacggcaaagcccatcttcctaaaaagttccactccagatagagaaactccttgtgaccctgtcaggaaattccacctttaaccttggaagtccttcccgctttcagggaagagtccatttctttcaaaggaagtcctagctcatccacaggaagtcctacggcatccacaggaagtcctttccacttcctttagaggtccctagtttcagttttcagcagttagaatggcctcactgaacaattacctttttttttttttggacataaacaaactttggtctaggaaatctcacccttcctataggaaatcatctgccttgggaagccctacttgctcccacagtctctccgatcctgacaagttgacattttggaaacattatcaatatttttagtttaaatctgacaggggctcagagtcccactttagtacaggaagttgtgcccaacaggaagtcccatcctcatctgttggaatggtttggctgacatttcaaacagctacccagagtcccttgctgtggatagtggttaaactcatggattccagctctaccacatacaaactgtgtttctttgggccgtttccttaacctctctgtgcctcatgtgtaccaaggaggagatactagtacccacccccttatgtgtcaagggttcggtggactaatctacataaagtgcttagccctgtatctgccatatggtgtcaatttaagtgttgactgtttactgccaaaacctggcctaagttgtctttgcctttcaccaccgtttccctacctcaatagttgtggctgtgacattgggcacttgctctgtactctggagctgcagtccaacccttgctgggcgtcttagggacggggctgtgggggagatttggatcctaatccttcccaccccccacagtctctgctgacacagaagtggtggggagatatggccagcactacacccatctgggccctggttctcgccttcttttgccctccactcatctacacccgcctcatcaccttcaggtcagtaccctggggtgagagtggtggggatgggggcggggtgctcagtttctccttcctgccccctctgcccacctttcttccctcatcggcccattgtgtcccttccctaggaatgggactctctgtccctccactaagggagtgctgtgggaggtgagttttgggggggatcctccctgtggtatctctagtggcagttactctgcctttctggccatggctctgggggaaggtccctttgggatgactttaggagaccacctctctgtccctctgccatgtctccgggtgaagaagtttgagttttgctggagaatgcctctccaccttctcttcccctcatttcttgctctgtgcttccccccttgctaggaaatcagaagaggagcccacacgggaggagctagagtttgacatggatagtgtcattaatggggaagggcctgtcgggtgagtggagcctccagcactgtgtgaggtggggacaccctgggcagttcaggacatgtgccagttccacgttgtgttagtcccctcttgagttgctacaaagttgctaaacctgagactgagtaatttataaagaaaagaggtttcattggctcatggttctgcaggttgtacaggaagcatagtgctggcatctgcggctggtgagccctcaggaagcttccactcatggcagaaagtgagggaggagccagtgtatcacatggcgagagcagaagcaggagtaggggtgccacatagatctcatgtgaactaactgagcaaaaagtctccaaagggatggtgctgagccatttgtgaaggacccaccaccaggacccaaacacttcccccaggccccacctccaacattagggattacatttctttgttctttttttctttttttttgatacggagtctccctcagttgcccaggctggagtgcagtggtacaatcttggctcactgcagcctctgtttcctgggttcctgatcagcctgcctcagcctcccaagtaggtgggagtagaagtgcatgccactacgcccagctaatttttgtatctttaaagtagagtcgggatttcaccatgttggccaggctggtgtcaacctcctgacctcaagtgatccgcgcactttggcctcccaaagtgctgggattacaggtgtgagccaccgggcccagccagggattacatttctttctttcttttttgaaatggggtctcgctctgtcgaccaggctggagtgcagtggtgtgatctccgcctcctgggttcaagcgattctcctgcctcagcctcccgaatagctgggactacaggagcccaccaccacacctggctaacttttgtacttttagtagtgacagggtttcatcacattggccaggctggtcttgaactcctgaccttgtgatccgcccgcctcagcctcccaaagtactgggattacaggcatgagccaccatgcctggcccagggattacatttcaatgtgagatttggaagggacaaacatccaaactatatcacacgtcccatcagggactgagatactgaggaagcttcccaggtgccaagctcaagacttggctcaagatttggttctgccatcaaggaggccatcaccagaaattgattttcttcatgctacacatacttccatccctctgtagcaagcggaatcagttgattgagggatttttcacctattttgttcgtggtcccaaggcccctgcttttaatcactatgctatggttgccgttaaggtattttaaaagtcaggcctaagcaaatgaaatagaatatttatcaaacttctttttttgttgttgtttttgaggcggagtcttgctctgtcgccaggcaggagtgcggtgccgcgatctcatctcactgcaacctccgcctcctgagttcaagcgattctcctgcctcagcctctcaagtagctgggattacagtcacctgccaccacgcccagctaatttttttgtatttttagtagagacggggtttcaccatgttggccaggatgctccccatctcctgactttgtgatctgtcctcctcagcctcccaaaatgctgggattacaggcatgagccaccatgcctggcctatatatagttttttaagacaatgtagagaggatacaaaatatttatctgtagccataaaaaagaacgagatcatttcctttgcagtgacatggttggagctggaggccattatccataacaaattaacaggaacagaaaaccaaataccccatgttctcacttataagtaagaactaaatgatgagaacacatggacacacagagtgaaacaacacacattggggcctattggaggacagagggtagggcgagggagaggaccaggaaaaataactagtgggtactaggctaaatacctgggtgatggaataatctgtacaacaaacccccatgacacaaatttacctacctaacaaacctgcacatgtacctctgaactaaaaataaacgtcaaaaaataaaaaaaagaacaaaatatgtatcaagagagaagggaaaaactaagataaacatttggaccactgagaaaggttgatagaaggccccagtgtctgaggtcaggatcagtaatggtgtccttccctagcaatttctcatctgcacatgtgatgatgatgacgaccttgataacagctgatgttatgaaacacgtacaatgagcaactactgtgctcaattcttttgaaaatcagttggttttttttttttttttttgagatggagtcttactctgtcgcccaggctggagtgcagtggcatgatctcggctcactgcaagctcctcctcccgggttcacaccattctcctgcctcagcctcctgagtagctgggactacaggtgcccgccaccacgcccggctaatttttttgtatttttagtagagctggggtttccccgtgttagccaggatggtctcgatctcctgacctcgtgatctgcccgcctcggcctcccaaagtgctgggattacaagcatgagccaccgcacccgtccggaaatcagttcgtttaattccaacaacccagtgcaatagggcctataattattctcattttgcaggtgaaataatggagtcattcagtcacttgcctcagatcatgtggttggtaaatggtagagccgagatttgatcccagatcctcttgtacctgagtctgtgctctcagcccctgtggagcccccccactgagagctctgttgaaggacagatcccaagatccccccagagaggctggggctgagcccaggaacctgcctgtggcctggctggaggtgattcaagatggcagatgtgggggaagctttctgacccaccgctctcccttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttttctttctttctttctttctttctttctttctttctttctttctttctttctttctctctctttcttttctttctttctcttttcttttcctttcttttctttttctttttctcttttctttctctctctctccctctgtcctctgcccctctgcctccctccctccttccttccttccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccgctgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttggtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctccccaaacccaaccagaccctgcttgtaatttggactttggactgatcctctccctgagcccaggttgaacttccttatttgtatttttttgagacagggtctcactctgtcgccaaggctagagtgtggtgatgtgatcgtagcttactgcagcctcgacctcctggactcaagcaatcctcctgccttcgccccataagtagctgggactacttaaaattagccaggccagcaggcctgcctaatttaaaaaaatttttggagagaggggtctcactatgttgtccatgctagtctcgagctcctggactcaagtgatcctccctcctcagcctcccaaagtgctgggataatctgtcacctaggctggagtgtagtggcaagttctcagctcactgcaacctccacttcccactcccccatacccagttaattttttgtatttgtagtagagatagggtttcaccatgttggccttgaactcttgacctcaagtgattggcccacctcagcctcccaaagtgttgggattacaggtgtgagccatcgcgcccagccaactttgttttttattgtggtaaaattatataaaattttccatttttacttctttttttttttttttttttttgacggagtctcgctgtgtcacccaggctagagtgcagtggcacgatctcacaatctcagctcactacaagctccgccacccgggttcacgccattctcctacctcagcctcctgagtagctgggactacaggtgcccgccaccacgcccagctaatttttttgtatttttagtagagacggagtttcaccgtgttaacccggatggtctcaatctcctgacctcgtgatccacccgccttggcctcccaaagtgctaggattacaggcgtgagccaccgcgccccgcctttttttgagatggagtctcgctctgtcgcccaggctggagtgcaatggtgcaatctcagcttactgcaacctccacctcccaggttcaagcgattctcctgcctcagcctcccaagtagctaggactacaggcgtgcgccaccacacctggctaattttttgtatttttagtagagatggggtttcaccgtgttagccaggatggtttcgatctcctgaccttgtgatccgcccgccttggcctcccagagtgctgggattactgacatgagccaccgcggccggagttgatttttaccatttttaagtgtacaagtcagtgacattaattacatttacagtactctccaaccatcaccactatctattttcaatacgttctatcacccagaacagaaagtgtgtccccatgaaacagcaactccccacttcccctccccacaggtcttagtaacctccagtgtattttctgtctctatggatttagtctagatgtttcatgtaagtggaattatgcgatatttgtcttttggtgtctggctgattttactgagcatgttttcaaggctcatccctgttgtagtgtgcatcagaacttcattcattccgttttatgaatgagtaatattctattgtacaaatagaccacatttgggcccagcgtggtggctcatgcctgtaatcccagcactttgggaggcctaggcgggtggatcacctgaggtcaggagttcgagaccagcctggccaacgtggcaggaccccctttttactaaaaatacaaaaattagctgggctcatgtctgtaattccagctacttgggaggctcaggcacgagagtcgcttgaacccaggaggcggaggctacagtgagccaagatcgtgccactgcactccagcctgggcaacagagcgagactccatctcaaaaaaagaagaccacatttgatttacccgctcatctgttgatgaacacttgggttctttctgccttttggctattgtgactaatgtttgttggaacattggcatgcaagtatctatttgaatccttgtttttatttcctttgggtgtgtatctcaaagtggaattcctcggtcatgtggtaattctatgtatagctttttgagaaaccaccaaactggtttccacagcagctgcaccattttccattctcaccagcagtgtatgagggttttaatttctccacatcctagccaacacttgttattttccttttgtaaaaattatagtcatccagctgggtgtagtggctcatgcctgtaatcccagcactttggggggctgaggtgggaggattgcttgagcacaagagttcgagaccagcctgggcaacatagcgaggctgctgtctctaccaaaacaccagaaatgagataccacttcacacctgcagcctcaacctcctgggctcaagtgatcctcccacctcagcctcccaagtagctgggactacagttacgtgccaccatacctggcttgtttttttaattttttttttacttttattttatttatttatttttagtagaaacggggtttcaccatgttatccaggatggtctcgatctcctgaccttgtgatccacccatctcggctggatcccaaagtgctgggattacaggcgtgagccaccgtgcccagcggctattttttttttttttaatgaaactcctttttaatcctatgttaggtctctctgtttgcttcctttcttgttggcatgatttttgctgagaaaatataaaatttcattggctttggttgtttttttttttttttttttttcagagatggggtcttactatattgcccaggctgatcttgaacccctgggctcaagcagtcctcttgccttggccttccaaagtgctgggattataggcacaagcccctgtgctggacctattgtattagtttcctagggccgccagagtaccaaaaactgtgtggctttaaatcacagaaattgtctcacaattctggatgctagaggtccaaaatcaaggcatccgtcaagctgttttcttctgagggatgtcggggagagtctgttccatgcccctcctgtcacgtctagtgctttgctggccatctttggcttctagttgcgtcattgaaacttctgctttcatcttccagatttccccttttaataaaacgttacttaaattggattagggaccatgctaataacttcattttaacttgatcacatgtgtaaactctatttccgaataaagccacatatttcataaataaaaaatttaaaaaggtctcattctgaggcactatgggttatgacttcaacttttttttttttttttttttttttttggagacagagtcttgctctgtcacccaggttggagtgcaatggcgtgatctcggctcactgcaacctccacctcctgggttcaagggattctcctgcctcagcctcccgagtagctgggattacaggtgcctgccactatacacagctaatttttgtatttttagtagggacggggtttcaccatgttgcccaggccgatctcaaactcctgacctcaggtgatgcacctgcctcggcctcccaaagtgctgggattacagccgtgagccactggacccggccggacttcaacatatctttagcgggatacaattcaatgcatgacactcatagatttatgagtttatttctggactttcaattctattccactggattgcgtctatccttatgccagaaccacacagttttttgggttttttttgagacggagtctcgctcttgtcacccaggcgggattgcagtggcacgatctctgctcactgcaacatccgcatcctggattcaaacgattctcctaactcagcctcctgagtagctgggattacaggcacctgccaccacgcccggctaatttttttgtatttttggtagagacagggtttcaccatgttggccaggctagtcttgaactcctgacctcaggtgatctgcctcggctttccaaggtgctgggattacaggcgtgagccaccatgtctagcccacacagtgttgattactgtaggtttgtagcaaattttgacattggaagtatgagtctcctttgttatttttcaagattgttttggctattctgggcctcctgcaattctatatgaacttaaagatcagagtttccatgtctgtcaaaaaggttgttggaattttctttttttttccttttttttttttcttttttttgagacagagtttcactcttgttgcccaggctggagtgcaatggcgcgatctcagctcaccacaacctctgcctcccgggctcaagcgattctcctgcctcagcctcctgagtagctgggcttataggcatgtgccaccacgcccggctaattttgtatttttagtagagacagggtttctccatgttggtcaggctggtctcgaactcccgacctcaggtgatccacccgccttggcctcccaaagttctgggattacaggtgtgagccaccgcgcccggccagttgttggaattttccgagggattgcgttgaatctgtagattgcttcgggtagtattgatatttcatctaggtgttctttttaatgcttttccagcagtatttggtagttttcaggctacaaattgttcacccttttggttaactttattcctaggtgcttaacctttagatactgttgtaagtggaattgctttcttaatttcctttttggattgttcattgcgggtgtgtagaaacacaactgatttttgtgtgatcttgtaccctgcaactttgctgaatctgcagccctagaagctttcttgtgattctctggcatttcctatatataggatcatgtcatctgtgaatagagatatttttacttcttcctttccaatttggatgccttttattttttttcttgtttaattgttctagccagaacttccagcacaatgtggaatagcagtggtaaaagtggacatccttgtcttgtccctgatcttaggcagaaagctttcactctttcaccattgggtatgacggtagctgtgggtttttcagaagtaccttttctcatgttgagaaagtttatttctattcctagtttacgatttttaaaaattatgatgcatggtggcttgtgcctgcaatcacaatactttagggagccaaagtgggaggatcacttgaggccaggagttcaagaccgacctgggcaacatagtgagaccttatctcaataaaaaaataaaaaatttgccaggcgtggtggtgcatgcctgtagtcccagctactcaagaggctgaggtgggaggaaggcttgagcccaggaggtcaaggctgtggcttcagtgagccatgatttcaccaccatcatgattgtgccaccaacagagtgaaaccttgtctcaaaaaaaaaaaaaaaaaaaaaaagccatgcatggtggctcaagcctgcaatcccagcactttgggaggccgaggtgggcagatcatgaggtcaggagatcgagaccatcctggctaacacggttgtaggggccagccctacaaggtctgtgggtttttctccccgtgtgcagagacaagagattgtagaaatgaagacacaagacaaagagatcaaagaaaagacagctgggcctgggggaccactaccaccaagacgtggagaccgacagtggcccctaatgcctggctgcgctgttatttattggatacaaagcaaaaggggcagggtaaagagtgtgagtcatctccaatgattgataaggtcacgtgagtcacatgtccactggacaggggcccttccctgttaggtagccaaggcggagagagagaggacagcttacatcattatttcttctatgctcttttaagaaagatcaaagactttaatactttaatactttcactaattttgctactgctatctagagggcagagccagctgtacagagtggaacatgaaagtgaaacaggagtgtgaccgctgaagcacagcatcacagggagacggttaggcccctggataactgcgggcgggcctgacatcagtcaggccctccacaagaggtggtggagcagtcttctctaaactcccccggggaaagggagactccctttcccggtctgctaagtagtgggtgcttttccttggcactgacgctacctctagaccacggtccgcttggtaacgggaatcttcccagatgctggcgttaccgctagaccaaggagccctctggtggccctgtccaggaataacagaaggctcacactctgtcttctggtcacttctcatcatgccccttcagctcctatctctgtatggcttggtttttcctaggttatgattgtaaagcaaggattattataatattgaaataaagagtaattgctacaaactaatgattgatattcatatataatcatatctatgatctatatctagtataactcttgttattttatatgttttattacactggaacagcttgtgccctcggtctcttgccttggcacctgggtggcttgccgcccacacatggtgaaaccccatctttactaaaaatacaaaaagttagctgagcgtggtggtgggtgcctgtagtcccagctactcaggaggctgaggcaagagaatggcatgaacccaggaggcggagcttgcagtgagccgagattgtgccactgcactccagcctgtgggacagagcaagactccatcaaaaaaaaaaaaaaaaaatcgtgaagtgttgttgaattttgtcaaatgccttttctgtgttggttgagaagatcatatggcttcccccacaccttgttctattaatttggtgtttgcattaatttttgtatgtttaactacccttactttcctaggataaatcccatttcgttatggtataaaatccacttaatgtgctgctgaattagatttgcttgtattttttcaggatgtttacatgtatattcataagggctactgctctgtaattttcttgtgatatctttatctggctttggtattacggtaatgctggcctcatagaatgagttaggaaatgttctctccttttcaatcttttggacgaatttgagaaacatccttgttattataattcttctttaaatatttgatagaattcaccagcacagccatctggttttgggcttttctttattgaaacgtttttgattcaatctcttatgataattctactgagattttctgttttttcttgagtcagcttagctaatttgtgtgttcctaggaatttgtccatttcatttatctagtttgttgacatataattgttgatagtattctcatacaatcctttttatttcggtaaggtcagtagtaatgtctccattttcatttctgatgttagttatttgtgtccaggctaactttggagcccaactttaacctgacttcaacctccaccttataccgtgataccatcccaacttgacctctgacatctgacccttggcccttctaaactgactttttttttttttttttttttttgagatggagtcttactctgtctcccaggctggagtgcagtggcacgatctcagctcactgcaacctccacctcctgggttcaagcgattctcctgcctcagcctccccagtagctgggattacaggtgcccaccaccacgcctggctaatttttgtatttttagtagagatggggcttcaccatgttagccaggctggtctcgaactcctgacctgaggtgatccgcccactccggcctcccaaagtgctgggactacaggcgtgaccaaacgcccttggctctaacctgacttctaatcgcatcctgtaacctctgactttagtgatcttgacttctgtctgctgctatagactgaacaattattgcctggcatctaaccttcgtccttgcccctggctgggccctgacctcaagtgacctttgacctctggcctttgcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgtaagaacagagcttggcttaaaaaggagaaatataggggaccgggagcctggaaggcgaggggaagggggcatgccccaaatgactaacgggcgtggcttaggtagcgaggggcggggtttaagcaacaaggggcggagcttaagcactgaggggcagtgcttacgggtgaggggcggggcatgttctcgaatcaccaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaagtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcagggtggacttggcactgaaacagctgggacacatccgcgagtacgaacagcgcctgaaagtgctggagcgggaggtgaggccttggggcctggctgggggactgtggcaggggtcccatctcccgctctgacattcctcccattccgcaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtg

SEQ ID NO: 4 - DNA, 33389 bp, Homo sapiens
ggtgccggagcgcgggcgcggcgcactcggagcgggatggagcgggcgcgcgggccgcgggccgaggccgacgcgcctgaggaggaggaggaggcgggggcggccatggctgctgtggtggtggcggctgcgggtggcgcgggaccggcggtcctgcaggtggccggtctctaccggggcctgtgcgcggtgcgcagccgcgccctgggcctggggctcgtgtcacccgcgcagctgcgcgtcttcccagtgcgccccggctcgggccggcccgaggggggcgccgacagcagcggggtcggggccgaggccgagctccaggccaaccctttctacgaccgctaccgcgacaagatccagctgctgcgcaggtgcgggcctgggttggctggaggcgggcaggaggcgggaggaggggcggcccgggctgctgggccttaggacagccctgtgaggtgggcactagtactgtcccagctcttcagatgatgtagccaggctccgcgaggctaggtcacttgcccaagatcacacagctaattggtgtcagagctgggagtctctgcaaagccctggctcgttccacgtttgtctgctttggttctccaaacgctaaggtggactcttatgacagccctgaggcaggcagctcagagacacctgtcctcattatagaaatgggaaaacgccttctagagaagggacttgacttgctcaaggtcacatattaagatagctgaggcctggctcagagctggagttcccaggctggtggtagcttagggccttgactgcaaggaaaggcgactggggatgggaggagggcatcaaagactaatagtgtcacagtcggatcacccattgaaccctcttaaggagactgaggatcagcgagagtaagagacttgccaaaggtcacacagctgtttgggatttgtctgactctgagtccagggtccctaacaccacctcttagcttccagagggaaggatctggagcttagaggggcttaaggtgcatatgaggggctataggagcatctgaagagttcaagtgggaagagctaaaggagatcagaggtgaaaattaaaggggcttgggagagaatttagcagggtaagaaggtagttgtcttatgaaaggaaaccaaagacttagtactgtaaatttgagttctgtctcatctctacttccactgccttaatctactccatcatcgtcacctgggctgttgccattatcctctaactagagttccctacttccattcctggactactttaccccagttcctctcactgctactgtagtgatctttcttgccatttgaaacagttatgcagtaaatgaatgagtatttttgctctccttccagcagcattgagatagtctcaagtatttgtcatcttaaaagcctttctttgatgtacattcccctccaggcttctctcgttgatctgtatttgatctgttttacacacaagcatctctgaagagttgtctacttgtactttgaatactttatcagcatccatttattcttacccactcatgaacaaataaataactggttttaccgtccttccccactggatcattcccatcaacatttacacatactgttatccccccactgacctctaaataacatccaaactccttaatgtttcacacaagttcctcataccctagtccctgccagtctctctctagttttatctgttagcaaacttcctttgaaaaagaatggagaggaggggatgttccaggtaaggggagcagcaacataaacaaaggtacagaggcatgaaaccaccttaaccatttggggatgtttgagcaaattttcatcataatacctgttgtactttcatttgtttacttttatgcctgtctctcccactggatagtgagctccttgaggtagggagtctgacttatttatttctatatcctcagatcccagcaacagcttcactgcccaggctgtcccttgccctctctaccccttcactatggcaggcccagttgcagctgtagccactagcagggttgaccctggtcctggtacagcccccagggctgcttgcagctctggccaggcaggtgccatgcccgactaagcagaaacccctggtgaggctctttattgaggaggagccggcccactacagagagaagaaaaacatcccatctacatgacagtgaagggagtggtgttttatgtcacctccagaaaggaattttatggaagaaggggccccctataatgcattgaccaggaaagtccaccagagggatagccaagatgtccctgggtcctccagacctcacccatgaaactctgggtctcatggccaaagagctggaatccctggatgatatcttcaccaaagtgtacaaaaccaaatatcccatggttagctacacagtctgaagaattcttaatagggacagcaccccagcctggacttcaaacctgaagaccaaccccattttgacataaacaatgtgttctgttgtttcatctccaagagcagcttctttggagggtaggttagggagatactcagatgctaaatcttctgcaaaataggctacctaaagcctctgaatcaccaggatctgaataaagcagatgtttaacctggttggggggacatattttcaagaactggatgtattcaagtaaaagcttgacacctagtaaggaggctataggattcttgtctgaagaggtgatccagcaagatgacctcaaaattctaagtaccctgaatgtaagtacctgagagactaagccctgtgtaaacctagggaacagcctgcaaaagaaaaatgttacacaggccccttgaggattaacaacagttgaataacaggatttctttttccagtttctttatttctaggcctgtgcccagttcttactaactgaaggcaaatttttcaacctctctgaatggcagtgtcctttctctgtagaggtggaaagtgatgctttgttattttagaattcaaaaaggcccagttggtttaccctttggtttacctctgatcaggtcagacccagctgcttttgagtcccgcctggagaaacgcagtgaatttcggaagcagccagtggggcattccaggcaaggtgattttatcaaatgtgtggaacagaaggtaagaccttcccccatttgtggtgtttgcttaccagcactccttcaccctccttaccctcacccttatccttaaagttggtttattgatgggtcagctgggtgaactgaacatagtctctcccaactccatttccatccataaatgtttatcctgctctttctaggcaaagtactgtggtcatggtggagatatagaagtatgagaggggtacttcctgctcccaagaggagcagtctggtggtcaaggcaaggcacacatggtagtaggctagaggtatcagagaaaatttcccatgggagatggaacctgacctaggctaggaacgttgtgggggatttaaattaagtagagaggaaggaatgggactttgatgtagagcaggggtcatcaaattttttctgtaaagaactagatgttaaatattttaggcattgtgggccgtatggtcttctttgtgactactcagctctgccatcatagtgcaaaagcaggcctagaccgtacgtaaatgaataggtatggttctgtcccagtaaaacttaatctacaaaaatatttggcagactagatttagtttcctgacaaccagccaaccctgccaacccacccccatccattcccatgttgaggaattagcttaaacagaggaagagctttgaaagtaaaaggggtttcaggagacagcaaggtactatgcccagttaaaatggagagggaagtgttaaggctaaagaaataagttaggcattaaactctttgggcttaaggagtacaggcaggataatttagctgctaagaggatgggctctggggccagatgccaaggactgaatcctaacccttccacttactagctgggtgactctgagcaaattgttacttctccatgcctcagtttgcttatctgtaaaacaggaataataacagtacctacttcacagagttgtgctgaagagataataccatttaaaactctttagcgccgtctctggcataagtacttaatatatattagccattattatccttaaataggaatcaaagctgaggaaaagcatgttgaaaactgtgtctgggaagattattctaatgcagtgtttttcaaactttttgaccatgaccacaataagaaatatattttacattgcaattcagtacacatgtaggtatatgattgtaactgaaaaaaaaatgtataaaataatgctaacttttacaacatgcagtccattcttattactttttattctctttcatcttttaaaaaactctgatcacaatccactaaatgtatttcacaacctattatttgaaaaattctaacctaggatggtgcacagaacaaactggtgtaggagaggccagcgccagggagaatatggagtaatccaggtgtgggctgcagaagcctgaattaaggtagttacagtagaaaattgggattctacattgtgttttaaagtcaaattagaggtgtttattttacttggaaaatactttttttgccttgggtatcctgaattttaagtgaatctgctgagtcttaatgactactactcatctgacaaagggctaatatccagaatctacagtgaactcaaacaaatttacaagaaaaaaaaaaccccatcaaaaagtggacaaaggatacgaacagacacttctcaaaagaagacatttatgcagccaaaagacacatgaaaaaatgctcatcatcactggccattggagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaacattgtggaagtcagtgtggcgattccttagggatctagaactagaaataccatttgacccagccatcccattactgggtatatacccaaaggattacaaatcatgctgctataaagacacatgcacatgtatgtttattgcggcactattcacaatagcaaagacttggaaccaacccaaatgtccaacaatgatagactgaatcaagaaaatgtggcacatatacaccatggaatactatgcagccataaaaaatgatgagttcatgtcctttgtagggacatggatgaagctggaaaccatcgttctcagcaaactatcgcaaggacaaaaaaccaaacactgcatgttctcactcatgggtgggaatcgaacaatgagaacacatggacacaggaaggggaacatcacacactggggcctgttgtggggtcgggggagtggggagggatagcattaggagatatacctaatgttaaatgacgagttaatgggtgcagcacaccaacatggtacatgtatagatatgtaacaaacctgcacgttgtgtacatgtaccctaaaacttaaagtataataaaaatagaaaaaaataaaataaaatgactaattgagttaattagaacaggattaatagtaaatgggttgccaggcgcagtggctcacgcctataatcccagcactttgggaggttgaggtgggcagatcacttaaggtcaggagtttgagaccagcctggccaacagggtgaaaccctgtatctactaaaaatacaaaacttagctgggtgtggtagcaggcgcctgtaatcccagctacttgggaggctgaggcaggagaatcgcttgaacctgggaggcggaggttacagtgagctgaggtcatggcactgcattccagcctgggcaaaaaaaaaaaaaataacagatgggttaattataataaggttggggagcaaattcaactcctatgacaaatagagtttacaactttatgtgagcaaacaattctttactacaaatattttaacaattgtcatttcctataataaacacttatagtagtaaggttacaagtcaatagctcttggaaatattactatattataaactttaaatattagataggaatgttctttgcccctttttggtaaacagacttagaaatttggctttatgaggccgggcgtggtggctcacgcctgtaatgccagcactttgggaggccaaggcgggcagatcacgaggtcaggagattgagaccatcctggctaacacggtgaaaccccttctctactaaaaatacaaaaaattagccgggcgttgtggcaggcgcctgtagtcccagctactcgggaggctgaggcaggagaatggcgtggagccaggaggcggagcctgcagtgagcggagatcacaccactgcactccagcctggacgacagagtgagactccatcttaaaaaaaaaaaaaaagaaagaaatttagctttatgataaaatgtagaatatgtaaagatttaatttaaattgtggcagctcttaggtaaatattcacttgctatcttctgtatctagctagatagaggaaggctaacggctaacacatattttccattcccacagtcttgtctttactactttgagttattggttccccaccacatgggactcaacatcccccttttataatacattttttaaaaattctcccttttctaccctgaaataaaacaataggtatgtaaaaatataacctacctgtatgtataacctcaggtgggaaaatcaatataatgccctaaccataatataaagaaaagtattttttaacaaaatacatattttagcatgtaaatattagggcacgactacactgtgagacctaatgtagtcatgaggtgcttccacccatttctgaaataaccttgaacatgtaagcagcaaatactgactggcaaatgggtgttatgttgataattataaaaactctaaaaccaccgggtgcagtggctcacacatgtaatcctagtactttgggaggccaaggtggcagatcacttgaggtcaggagttcgagaccagcctgggcaacacggtgaaaccccgtctctactaaaatgcaaaagaaaaattagccaggcatggtggcgcatgcctgtaatcccagctactcaggaggctgaggcaggagaattgcttgaacccgggaggcggaggttgcagtgagcggagattgtgccactgcactccagcgtgggcgacagagtgagactctgtctccaaaaaaaaaaaaacctccaaaaccatgagcagtgttgttatcagtgacctatgattccacaatgtggaatctttcaagttatatagtagttgcatttctggaaattttagtattaaagcagtgtttaaaaaaaaaaggttctaggcccaagtaattataaatattgaaatattataggtattttcagctgcaagaatgtctagctagacattgaaaagttgtacaggatgagggaaattttttttattatgtagaactcacccatttgacacccctcccataatgtagatatcaatatccaataaactattatgataaccataaaattatctgcacagatttccaaagcatccatagtagggaagtaaaatacccatttaaagttcttattaaatgcttctgatttttgacatgtagtttcaactgctttaattaccttatttcatcaaatctaaagctcactcttatttttctcattttaacatcactaaaattgtcttataattgatatgacaggaaaatattgtgctatttaattggcatcattttctgatgcataaaataatggtgcatcttaagatatgatgtcttagatttgataaaatgcaatacgcttatacttagggcttaaattttttatttctataagtgaaaatggatacaaataatagattggagagacattgtgtaaaaaccgatacatgaggcttcatgactgaaaggtgaaagcagctgtgcaagtggaggttttgttttgtttttgtttcgttttcatggtacacctgagaatgagtggtatgaaaatgaaattctcatcaggcacagtggctcatgcctgtaatcccaacactttgggaggccgaagcgggcagatcacttgaggccagaagtcaagaccagcctggccaacatggtgaaaccccatctctactaaaaatacaaaaaattagccaggcatggtggcacaagcctgtagacccagctactcgggagactgaggtgggagaatcacttgaacctgggaggcagaggttgcagtgagccgacattgtgccactgcactccagcctaggcaacagagctagaccctgtctcaaaaaaaaaaaaaaagaaagaaagaaaatgaaattaactcctttttagatggtttacatatgaaggaacggctacactgggatgttgtcagtgtataggtgcgtgaccaaaaagactaaagggtgttcaacaggcttttctctaatttgtgggtacaggttctatgaccatcatttatgaaaagtgtggattaattaaagcacaaagtgactaaaggcaaggttttatgcagaaagtgtttttcagcctcagaatcccaggtgtcgaatgtacttctgagaagcacagccttgagtggaagactcagaacaacccatccctactaccagaaactactcaaaacaggatttactagctatgacctttatgagagataatggctacgagacaaaataatcactttcagttgttggtggcctttttttaagggtgtctaatttgatagaggaaacattaagattgaacactcaaaatgactctagtctgctgaggatgcctaccatcaaagtgttgtcagagataagcagtatccttggataacacatctttccatttcttacctctcccatggctcagtgtggaataggtcaggacagagcacagtaatcccaagcaggcctaattctgggaagaaatccctcatatccacagtggcaggtggagaatggactctcagtactagtagatgatagtttactgagagagaaatcttatctctgaatctcagaatcttagaagaaagttgttttcttataaacaataatttttatttttatttctttttatttatttattttattttatgagacagagtctcactctgttgcccgggctagagtgcagtggcgtgatctcggctcactgcatcctccgcctcctgggttcaagcggttctcctgcctcagcctcccaagtatctgggatcacaggcacccgccactatgcccagctaattttttgtatttttagtagagacggggtttcaccatgttggccaggctggtctcgaactcctgaccttatgattctctcgcctcggcttcccaaagtgctgggattacaggtgtgagccactgcgcccagccaacaataatttttaaaatagtgttaaaattttagaacaattattataaaaagtggagagaagtgagttctcacatgcaaaattatttaatgagattgggtacttcacctagcttagttaccttttttcttatgagtaaagtgtagattaatatcttgtcttatatatttcagacagatgccttggggaaacagtctgtgaacagaggattcactaaggacaaggtaggtttctaattaaatataggaaaaaaagcttgaagtcatatgggacatctagaacaagaggctgcaaatttgaacataagtactgtggctcagtgattttgtgtaaggtgattttccagctgtagaagtgagaaatatttctatgaactttgtgtccttgaccatgacccctagcatagcagtttaattaaaaataacaaccaaactttctcctcttaccagctgcaaagtgccgcaggactcattggtaagggtgaagcctttgggaagtacatggcaacctaagagagactcctcaggaacagaactatgaaaacctgtctaggcttgggggctcactttctctgagcatgtgggttttcttatacttgttttctacttttggaaatctgtttcattgtcctgacatgtttgccacaggcttagagatagagttaagctgtttttttttttttttaattatgtgttaattgctttttattgtctctttcaagactctcagttcaatctttaacattgagatggtaaaagaaaaaactgcagaagaaataaaacaggtaatgaatggaaatgggctggcctactctatgaaaatgtgaattctgtgaaccaaatctgaaagtacattttctgacacctctttctagccacaatgaaaggtaataataaaaggcaaaagtgatgaattacttgaagaacaatgtcataagaaaacttgtcttctttgtcactcttatatgtctaatcaacttgtatgtctagtttctttttcattcccataatccacatctcgtgtaaccctcatcagtactctgtacctggattactgcactacctttccaaataggtttcccttctccttttttttccactccacccataatattctcatcaactgagtcctctgaaacttctcctttcattatggagaagtatagtgtattggtttaaaaacacagactctagaaccaagctgccggttttaagtcctagctctgccactatctataggacttggacaagttaatcaacttgtctgggctttagtttccctatttaaagtggagcaaataatagcacttacctcatagagttatttggataattaaatgagttaacatttattatcacttagaacagtccctggcatagagtaagtgctatatttatgttttttaaaaaatgggaaaaaaatgtattaggaacctggtcacaaatgttcagtgacttcctgtattccttttctgggcattcatagctctccattatcacaggaccttcttcaggaagcttcctgaacactttccttcaaagcactcatgagctatcctgcctgtttggtcatttatatttttatacctgtgattcttttctctctaataagctatttttctggcattctttatagttccatgaattatacattaggtagattgagaggatcaaaataataataaaagcagcatactctgtatcaggtacaatgcctaatgcttcatatgcattatttcattaaattctcttaaccaccccgtgaagtgggtgccattattcccagtttacagttgaggaaactgtgacttaaagagattatgtaacttagtcagtggtagagctgggactcaaacccatgtctatttgactctgcatcatattcccacaactggaagttgtgccagttgccatgggtttcctttgtatgctgtatcatttattttagcacacatttaatgcataccaattaaatgtcagactctgtgccagatacagagataaatgagagaatcctcatccccaaggagttttagcctccgcaaaacggatcagatcagcacagggttctttctattaatagaggcatatgcaaagtgtcagggagaactctggctgtgcctttgggaagaagtaccaaaggaacatggacacaaaacatgtcatttaggggaaaaagaagccaggcccaggaggcctgatcatatgacaagtatcattgagacctatagttttaggtataaatttgtgtttgttgaaatgagtagctaaattcaactatataaggaaacatatatcagtctcatgaatttcagttttgattcataaactgtctgctaatatcataaattaaataaaaataatcagaatatgctgtccttaaaatgagaagacaatgttttgacatgcaaaaaaagaaaaggtaaagcaaccttatgccacattgagagtagtttccataggtcctaggagttaatagtccttttgtgctctgtgttgattagatggatcacactttgattagtatcttcaattggggccccatattttaacagaaatgttgacaaaacagaccaactctaaaggaagttgacccattcttcaacactagctcactctggtgtcaccttggttatgataccctcctctacttctatgcctttgttagtgttgtcattctctgcttcaaatgtgtctcttatctccttctcctgccctacctgttatcttcccagcctccttatttccctactctaactcctaatcattcttcaggatacagttccaagtgtcccttcctctggcactcttccctaccctgggttaagtgcctcttttagattacatgtttcttattatttcacaatcatctatcattcaaccagcatttctgagtactttttgggttgcaaggcattggtgacaacacagcagatacctgcctacagggggcttgcaaactagtgagggaaatagatccatatgcaaatgatcttattatgaagtagcatatcctaggcatcttaagagagatataaaatatgaaagcaagggggaggaaataaataaaatagaaaagcagctcataggaaaacttctgactgtaatatcaagggaaactgcatggaagaagaagcatataggctcagcttcagagtacaggaagaatttgggaggtcagaggtaggagagagaggctttctagtcagagccaataacatgtaaaaaggcatgggaaggcaaaaaaaaggtagtaaaaaataagaacacagagcatccatatgatattaatggtaaataatgaaaagacacaatattgcatatatgctacatctatgtatactataaaagacatgctagaaagaaataaagtaacagtggtctttgttagggtggtaggactatgggcattttttccttttccctgttttctaattttcaaattttattatataatttttttattccccaccttttggtatttgcatcatgaaggtcaactgtagcttccttgttcgttagtgtcaagcagaggtaggacttctgattggtatataccatagtcagatccaacagaccttatctcttccacatgtagaagactttctggaagcaggattttaagagctgcctataacatgccaataatatctaatatggttttgctgtgtccccacccaaatctcatcttgaattgtagttcccataatccccacacatcatgggagggacacaatgggaggtaattgaatcataggggcagttacctccatgctgttcccatgataatgagttctcacgagatctgatggttttatagggggcttttcccccttttgctcattcttcttcctgtcaccatgtgaagaaggatgtgtttgcttccccttccaccatgattgtaagattcttaacgccttcccagccctgtggaactgtgagtcacttaaacctctttccattataaattacccagtctctggattaagaaaatatggcacatttacaccatggaatactatgcagccataaaaaagcatgagttcatgtcctttgcagggacatggatgaagctggaaaccatcattctcagcaaactatcacaaggacagaaaaccaaacaccgcatgttctcactcataagtgagagttgaacaatgagaacacatggacacagagtggggaacaccacacactggggcctgtcagggggtggagggctgggggagggatatcattaggagaaatacttaaagtaaatgacaagttgatgggtgcagcaaaccaacatggcacacgtatacctatgtaacctgcatgttgtacacatgtaccctagaacttaaagtacaataataataataataataataataataataaataaataaataaattgcccagtctcaggtatatctttattagcagtgtgagaatggactaatacaatatctaacaaaagctaacattatttgtagtgtttattctgtgacaagtgctgagctaagcacagacctacattatttcagctagtcatgacaattctgtgaggttattattgctattttattgatgttttttagggagttttcagtaatttgcccaaggtagtatagctagtaaatgactggagctgagattcgcatccaggtctgcctgactgtgaaccctgagctctagtcctgactctctgggaaggctcagttggctggggaggtgtgggtttggggaggaaataaaaatgtgaaaaaaaagaagttgtctatcacacacaaggcacatattaagaggaatgacttttaaagtcagagaatcagtttctctgtcaggaatttgttattaagagttacagtttaatcatctagaagagtggattgtattaaatcttttttgtgatgtgctagtaatgaaagcgttatactgggtttttcctctctgttatcaaatagcatattcctctgagcaatgaaaactgtcaccatttcttggcacatgttgaaaagattacccacatgtcacagacacccctctcttttttgtacagatttggcagcaatattttgcagcaaaagatacagtctacgcagttattcctgtaagtagtttggagggcaaagtgaaagtgttacaacatgaaagtcagttctctaaccttagcaggcagttgcctttacttttcctatgtttattgcctcttgagaagctgcattttacagccctgagagtttttattatgccctgagcaccagagattggaagctccatatggtatatttatggctcttgttttcctcctttctactttagaaatgtctctgagtcaagtctctgacaagggagcgtggtataagttcatgttgctgagtaatttccagatgtcttttttttcttactgatgttttccaaccaagctgttggaatttaagacagggcctctagcacagcttttttcccttcttgcctgtaagtgacctatacctgagctgacttggagcctcttcctagtctatctctggtgaatattccccttagcaagtggcattttcttggtctttcccttcttgaaattattcttagagatggtcaccatctactgcttgaccattaaggtctgtgacagagaagggatgctgctggcttctctggtttaatgttttgctggccttcactataataaagcatctgaagtactggattatcagctagttctttgtttttccctgaaggaggggtgggagcttaggttaagtttctatcaagcacacaaatatatattgagattacatgagtaagtgtaagattaaggaggaaaacatatagatggaaggataaagccaggccttttggtggttatgatggtatcgctatctttttttttaatctctcatatatatatacccttatcctacatgaattcaacagccagaagaagagtctgcgctttttgtgatgttttagatctctgatactgactcattgtttaaacaggccttcttacctctccctcaaactgacttggtgacttgatgtctctgacaattgttaaagttccctggagcattggtgcacctagtctttacacataattctgacaataaacagcaaaacagacatctggtttttcctgtctttctgtcataagagtgatttgaaaatgatgaaacttaaatgactgttttagttgtattataattctagaattcagtcttggtgaattacatgtgatagtggccttttgtgttttactatgtgtaggttaactttattcttttccaacctacaggcagaaaagtttgatttgatctggaaccgggctcagtcctgtccaacagtaagtttctggtgatcacgtaagggttgcttatcaatgttgccaaacaagtattttccagcccatcacgtcatattccatactgtctcacatgttatagtgctctgtttacttaataaagatgctcacatgttgattgtactaataagttatagtgctctgtttacttaataaagatgctcacacgttgattgtactaataagtgacattttcagccttatgaaatcatgtgggtttgacccagtaagcctctggctttttagctccctaccacatcagccctttctgatgtagatcttaatctatcggtacaagtgcgttttggaagacatctgagaccttaatcttttcaacttctttttttttttttttttgcttttattattatttttaattgacacataattatacatatttatggggtacagtgtgatagttcaatacatgtgtgcagtgtgtaatgatcaaatcagaataattagcacatctatcacctcaaacatttatcatttcattgtattggtaacattcagaatccattcttctagctacttgaaaatatacaataattgccattctaactggtgtgagatggtatctcattgtggttttgatttgcatttctctgatggccagtgatggtgagcattttttcttgtgttttttggctgcataaatgtcttcttttgagaagtgtctgttcatttcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtatgcttattgcagctttattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatggcaagaacaaaaaaccaaacaccgcatgttctcactcataggtgggaatcgaacaatgagaacacatggacacaggaaggagaacatcacactctggggactgttgtggggtggggggagtggggagggatagcactgggagatatacctaatgctagatgacgagttagtgggtgcagcgcactagcatggcacatgtatacatatgtaactaacctgcacattgtgcacatgtaccctaaaacttaaagtataataataataaataaataaataaaaagaaaatatacaataaattattgttaattatagtactccatagtgccgtagaacactagaacatatttctcccatctagctgtacttttgtatcccttaaccaaactttggctattcgttcctctagtaaccactctcctactctctccttctatgagatcaggtttttttttttttttagcttccaacatgtgagaacatgtggtatttgtctctctgtgcgtggcttatttcacttaacataatgttctccaagctcatccatgttgtcacaaatgacagaacttgttcttttttgtggctaaatagtattccattgtgtatagataccacattttctttatccattcatttgttgatggacacttaggttgattccatatcttcgctattgtgaatagtgctgtagcaaacatgggagtgcagatatctcttcaacatactaatttcctttcctttggatatatatccagtagtgggactgctggatcatgtggtagttctctttttagttttttgaggaaacttcataatgttttccataatggctatactaatttacgttccaccaatattatacaaaagttcctctttctccacatcttcaccagcatttttttttttttcatttagagatgaggtcttactgtgttgcccaggatgggcttcaaatcctggcctcaaatgaccctcccacctcagactcccgaagtgctgggattacaggttgtctttttttttttcgtaatagctgttcaaactgggctgagatgcctgttttattggcagttttcttcacagttttggctatgctatcctggtaatatgtgcctaaaggaattaagaggtcgtagctgaaatactgagctgccagaaggcctaagggaaaaggaataggtggggtggaccagctaacttggtatcagtaatgatttctcgggttttcaaaacatttttggaaacattgctgaaaacagagaatacctaaataaatggaaatgatatataccatgttcatggattggatggctcagtttgttacattttgttttgttttgttttttgagacaggatcttacagtgttgcccaggctggagtgcagtggtgtgatcatagcttactgcagcctcaatctcttcagctgaagcaatacccccacctcagccttctaagtagctgggattacaaacatgcacccccatgctcagctaattttttgtatgtttagtagagacaagatctcacttacgttgcccaggctggtctcaaattccttggttcaagcaatcctcctgcctcagcctcccaaagtgctgggattacaggtgtgagccactgtgcctaggctttgttattgttaaggtatcagttctctcctaattggtctctagatgaaatacaatactaatcaaaaccccactaggcatttaagaaattgatgagctggttttaaaattttacttggatatttaaaggactgagatagctaaaacaattttgaaaaagaacaaagcttgaggacttacatttcctgatttcaagacttattacaaagatacagtaattaaaacagtatggtattggcacaaagatagacatgtagattaatggaacagagtagagtcctgaaatagacaaacatatatgtggttagttgtttttcaacaaaggtgtctataaattagagaaaggataatcttttcaacaaatgctgctaaaacaattgaatatcatgcacaaaaaaaaggaacctctacttttacctcacagtgtatacaaaaattaaagtagatcataaaagtaaatgtaacttttttttttttttttttttgagacggagcttgctttgtcacccagggtgcaatgtagtatgatctcagctcactgcaacctccacctcctgggtttaagctattctcctgcctcagcctcccaagtagctgggattacaggtgcctgccaccacactgggctaatttttgtatttttagcagagaccattttttttttgagtcagagtcttgtactgttgcccaggctgtagtgcagtggcatgatctctgctcactgcaatctctgcctcccaggttcaagcgattcttgagcctcagcctcgtgagtagctgaagttacatgagcccaccaccacacccagctaatttttatgtttttagtagagacagggtttcaccatgttagccagtctagtctcaaaactcctgacctcaagtgatccacttgcctcagcctcccaaagtgctaagattacaggcatgagccaccgcacctggcccataaatgtaacttgtaaaggaaaataaaagaagaaatctaaattaccttgggtttggcaaagatgtcataagtacattacaaaaagcacaaactataaaagaaaaaaatcaccttgggcaatatagtgagaccttgtctctataaaaaaaatttttcaagcacctgttgtcccagctactcaagaggctgaggtgggaggatcacttgagccctggaggtggaggttatagtgagcccagaccggacaacagagcgagaccctgtctcaaaacaataaaaatagggtgggtgtggtggctcacgcatgtaaccccagcactttgggaggccaaggtgggtggatcacttgaggtccgaagttcaagaccagcctggccaatatggcgaaaacccatctctactaaaaatacaaaaattagctaggcgtggtggtgtgtgcctgtaatctcagctactccggaagctgaggcatgagaatcgcttgaacctgggaggcagggactgcagtgagccgaggtcacaccacagcactccagactagctgacagagtgagattctgtctcaaaaaaataataataaataaattagatttcatcaaaattaaaacattctatttgcatacccaaatagcttctacattcatagcaacattagtcacaatagccaaaaggtgtatagctcaagttatatcagaaattcttataactcaataataaagaggatagacaaatggacaaaggatttgaacattttatcaaagaatagcagataagcacctgaaaatatgcttgacagcattagtcataatgggaatccaaattactacagtgagataccattagaatgactaaaatgtcaaaaactgatcataccaagtattggtaagaatgtgaagcacctggaactctcctatactgccggtcatattgcaaaatggtacaaccactttagaaaatagttcggctgtttctttaaaaattaagcatatacctgccatactaactagccattccatttctagatattttcccaagagaactcaaagaatatgtccatagaatgacttgtgcgcaaatattcaagcagctttatttgtaacaaccaatgctggaaacaatgcaaatgtctgtcactagtgcacaggaattgtggaaagagagaatgtgcatgtgtgtgtgtgtgtgtgtgtatgtgtgtatacatacacaatggaataatattcagcagtaaaaggaatgaactattgatacatgcaacaacatggtgttctgtgaaagggccatatgtgcaaaacgacccccaaatggtgaaggagctgaaaaaccaaagaaggaggcagacaaatccaatttgtgggtatgggatgatttattgggggaacttacagacgggaatgtcgtattgggtggctgcaatacaggtagatctccacaccacaaccagacagacccaatatgtcttatatcttggggaaagtatacatgctctggaaggaatgtgtaggtggatacagtcatcactgcctatgatttctgcaacaacatcaaggattgttttggaagaatagatgtttctacataaagagtaatacatcaactagacatttgggaggcattcctggacttggggttagtcagaagtcacacggtggactagcatttaaaataaagtcactcttgttcctacacatggatagatcatgaaacagttatgctgactgaaagtaaccaaaccaaaaaagtactcattttgtggttccgtttttacaaaattctacaaaggcacactaacctatagtggcagaaagcaaatcagtggttgcttagggacagtaagggacagggaagtatgaacttcaaagggcaaagaaaacttggaagtgataaccatgttcattttgttgattttggttatggtttcacagtacacatatgtcacactcatcaaattgtatactttaaatatgtgcactttgttgtatttcaagtatacctcaataaagctgtaaaaaaaatattttccctagcaagggatcatctgtcaagtaggcactaagtttatctcatctaataataataaattggagcctgagtggttgacaataagaagataatttgtgactaatgtgtattgggctgctttatacttttgttttgttctggcaccattcttttctctactactcatccccattctaaacatcttgagcataaaacttattttttggtgtttagtctggagccatgctccaatatcagccttatctgatagaatgtgaagtaattacagcaattggaacgagctaattcagcagcattagaaagtttagaaattgaaacatccatcaagagaaggataaatagtgataaacttctacaatagaattccatacaacagtgagatatttatgaattcagagttatagatatcaacatggataaatctcagaagcatactatgaagtaaaaaagttacaaaaggatacacacactttgataagatttaagtttttaaacatataaactactactttaaaaaaaatttttctaaagacagggtctcactatgttgcccaggctggtctcaaactcctgggctcaatcagtcctcctgcctcagcccccgagtagctaggacaacaggcacatgccaccacacctggctattttttttatttttttgtagtgacggggtctcactgtattgtccaggttggcctcaaactcctgagctcaagtgatcctccgaccttggccttccaaagtgctggaattacaggtgtgagccaccatgcccagcctgtaaactactacttcttaacttacagttatacgcatatacattaaagtattaaaatatgaaaaaggaggatagacaccaaatgctggatagatgttaactctgggatgggattagaagggaatgcagagggaacctcaattgtatttctgatgctttcttaggtggattgataagtacatgagtatttattgccacatatgaatttcttaattttaaaaaaatgttttaggctgggagcagtggctcatgcctataatcccatcactttgggaggctgagggaggcagattgcttgagcccgggagttcaagaccagcctgggcaacatggcaaaaccccatctctaccaaaaaaaaaaaaaaagtagccaggcttagtggtgcacacctgcagttccagctacttgggaggctgagtgggaagatcacctgagcccagcagatcaagactgcggtgagctgtgatcatgcctgcactgcagcctggacaacagagcgagaacctgtctcaaaaaaataaaaaaatattttaaaaaccaaatatggaggaaatggaatgaatgttacaggtggttggatatagagcaaataatttcatttattcatctgtctccttgtatatctgtttttcacagtttctatgtgctctgccaagaagggaaggttatgagttttttgtaggacaatggacaggtactgaactccacttcactgcacttataaatattcaggtaggtggcttgtgcccttcctctagaggaaagaggactaccccttggtaggactagaaacccttgctgaggctcaaggacacagaatagctgcttactcccagcatttattattgtggcgcagatgaattgtcatactttttgtgttggactagttttctaggccctcctcaatacctagaaattggaaaagactccaaaacaccttctctgactacttctggttctcttttgtctcttccccagacctctagttgtatatactgcatgtgcctcacttaacaaacatgcctgagttatgatggctatctttttaacccaagctagaagccccttgaggaaagctccaagtcttaaatgtgttttattacctaagtcaacaccttccaacatgctaagtgaatagtttctgtttaatgttattttgtttgctttcttcctttatttctttatttccaataaaacaatattaacttttaaatattatatttaaaagttagattcaaaacatttaaaacttttaaaataaaagtcaatattttaaatcataactaggattggcattctatatttggaggtcaaatgtggcaaaaaacaagcacgaattatattggctttgaagttggggtaaagaatgcaaaatagaatgaaggaacagctttttactttgctattttgtaatatgtctaacaaccctttattgagtacatactttaataaccaacaatttgatgtacttactatgtgccacatgttttatatatattatgtcatttaatcctcataatacgccatatttactgttattatttctaattacatagaagaaagtggcctcagatgttagttacattgtctaataagtgatagagccaggattgagcccaggttatctgacttcaaagtctgtgaacttaatcattatgggattgtgttaggaactgtgctaagacttggagatctgtgagacaaggtccctgccttcatggagctaatattcagctttaggagaaagatccagaaacataattacaataaaagtgattagtataatattagaatgatgaccaaaatgatcagtgtaacattagaagtatgttcaagaaaaatgagatgctgaactattacaagtaccctagtgatagttggatatttataattaaaaagactcgctgaaattttagagataaagtctaggaatcttcttttgaatgtagttgtttccacctgtgctatgtaggggctttagctttgaacccatcctctctacctagtctagacttgagatttagtaaccactgccctgatcattcttcataaaatcatggtgtttccatccttcttctccccttcaccccccaccaacccagattatattttagagctgcacattacaaatctggctcatgtgcaaactctgcagctcctgctacagcttaaaagagctcagtcttcagagccagccaaggggagtagatttcaactgtgaaatgcactagtccatgaaagtggcaattacacaggcacattgctttctttagaacttgatttggtagctgcttgtgccattttgtttttaaatgtatggtcacaatgatggattcactgcctactgtaaacattttctgggaaaaaagccaaaccttttccagttgaagacacaaataacactgtgcaaactgtcagtttcactgtgcctttgcaggcctgaccttaccaccacataccagtcctccaactcactagccacccaaggggctgttaagagccagaatttcctctagactgtctattgctttgaaattgcagtttgttgtgatggtaccttattgagccttgataagtgttccaccttgcagacccgaggggaagctgcagccagccagctgattttatatcactatcctgaacttaaggaagaaaagggcatagtgctgatgactgcagaaatggattccacatttctggtaagaattaacttgcaaaactctttggatttacctcatggcactgaaggtattactcttctgccaaagctcatgagagagaaaatttcaaagagctacatataccttgtttcttacttattttaaagttgacagtgaagttgtcttgctcaagatcttccaatttgaagttagtacagatcctcaatcatttattcacaattctgaaacccatgggctctgagaacaaaatgtttttgttctcatttggtcacaaaaccttatgtaaacttgaactcatttggtaactaaatctttaaactgatgtgaaactatttatataactaatcccacttggtgtggagtattatgcattttactagggaaatattaatgtgtttgagtatggggagtcacataatatagttatatagtatctatacctattatctttctaaaattcaataattctgaatctaagacacatcaggccctaagggtttcagataagagattgtagacaagtaaatggcttcttaattatagggaagagttgtattgaagcctaggatagctctcaatattttatcttccttcatactgttcatttatacaacattcatcatttatagtgtttttctttcctccttttcccactcctagatgagaatcactgagatagagcattgaccatatgctcatagttaatgatgcccactgtgttctctctgcacatccaggtgccaggagcagtgttgtgattactgtacactgtctgtctagtccttgctcatttcagtcacatatccttttatctggcagaggttaagttcagaatgtccccaaacagtggacacttccccctaacagtcttcattacagcacccacttattttttctctttctcttaccagctgcatagggagaaagaagtgatatcactcagctgatatctcacagtagcagtaacccacaaacctaggacacagtgaggattctacttccctattcttgaagctattcagtaccatctctcccattcttccttccacattaacccttccattcatcacattcaactgaaagccaaaattctatccaagaatatggaattgccattaactgagataggcaagattgcaggaggaataggcctaacaggaaaatcaggagctcacttttcgatgtattaaatctgagatgcctattagatatccaagtagtaggcaattagatatatgagcctggacttcatgggagaagtccaggctggagatataaatatgggagttgtcagcatacagattgtacttaaaaccataggactgaatgaagtcaccaaggaagtaagtaaaaatagagaagagacgagatctaagaactgagcgaggggtctccatccctggagagatgaagaagcatcagcaaagattaagaaggaatggccatgaggtaaaaggaaaattaagatggtagaatgccctggaagctaaaattgaatgtttcaaggaatagggactgctcaactcaccaaatctcccttgtttattagggcaaatgagattagaactgagaatttactgatttcacaaacatggaagtcactgggggccttataagagcagtttcataaaagtgtgattggagtagacttaagagaggatgggaagagaaactccgaagaatcagcatagaaactctttcaaggggcatttctataaagggaaggagagaatggggtattagctggaggtggagaagtgcgcccaagggtatcttttgtttcaaatatgagaaagaaaacatatttgtatgctgatgggaaaggtccagttgaggctgggacagtggctcatgcttgtaatcccagcattttgggaggacaaggtgggtggattgcttgagctcaggagtttgagaccagcctggccaatgtgatgaaaccctgtgtctacaaaaaatacaaaaattagccaggcgtggtggcatgcaccttgtaatctcagctgctcggaaggctgaggtaggaggatcacttaagccccagcagcaaaggttgcagtgagctgagattgcaccattgcactccagcctgagcgacagacccagactctgtctaaaaaaataataataataaaataaaataaataaagatccagtggagagggaaatgttgatgatacaggagaaagcgggaagtgatatttttgagtgggcaagtctggtaatgaggggttgatctttaccaggaatatgacagcaggagagaagccagagtataaggacactgataaaattagatggatagaggtagtggtataagtttcctacagattgctcagtgaaaagaaagaaaagttctcatcagctgaaagcaaggttggaaaaatgttggacatttgagtcaaaaagaggaagtacaaaattgttgtctaggacaagcgtcagcaaactacagcctatgggccaagtccagcccactgcttgttataacgcccacgagttaagaatgttttctacctctttaaatgattagggggaaaaactctttttttgtttgtttgtttgtttgtttgtttttgagacagagtctcgctgtgttggccaggctggagtgcagtggcacaatctcagctcactgcaacatccacctcccaggctcaagcagttctcctgcctcagcctcaagcagttctcctgcctcagcctcctgagtagctgagattacaggcatgtgccaccacacctggctaatttttgtatttttagtagagacgaggtttcaccatgttggccaggctggtctcgaactcctgacctcaggtaatcgacccacctcggccttccagagtgctgggattacaggcatgagccaccacgctgggccaaaaactctttattcttaaagaaatacagaaattatttaataacaaaaactattattaaagaaaaatagtatttcaagttttattagaacacagccatattcatttatttacatattatctatggcctgaaggaagttaaaggtgaatgcaaaggaatgattattgaccatggaatggaagctgggtaatgaggaaagtgaaaatataagggaggttagagacagtaagaattatgagtcctaatgggttgtgggagttggaagtgagctgaaaagataggaaataatttgatcatgcaagtgagtgacaatatagagattgtactatattttctggtcttcggcaaagcacagcatctaatcatattaaaagtggatcctaaaggtcagaggaggcccattctgctgtttgccatttttaccacctcactctggtggtctcaaactgctgtgcagttctcatcattgttaaaatttgcttcctggccttttaacatttgacagcatacaagacaatacatatttgccttgtataaatcaacttgactgtgaggttccgatgtagtgtagaactagacatgttagaacttgttgtacatgacttagagaagagaaacttagaagtataagatgaatatatgatcccctgtatactcatgcatgaattgtgcactttaggcatagtatttccaactatggtaaagcattaatgtcaaatgaatagaaatacatggaaactagagatttcttctgaactaactttaatgctaaaaactaatggaatatttaaaaacctagctttatttggctccacatctatgtcaatagatgatttcattgaaatgcagtaagtgctaggatagacatgcagaaggttctagggatagagagtggggtgatatccctggcccaaagggagtaatatttcctggagatgacacccagactgaaccttcaaacagcaggagttagcctaataaagaaggggagaaatgtttccgacagagggaatagcataagtaaatgctgagagacataaaatgacttggagtattgtaaagagtttggtatcacttgtgtgtgtgtgtgtgtatgtgtgtatatgtaaggtttggtggtttttgtttagagatttggctttaccctgagggcatgaaaagagtcattaaagggtttgaacagagaagaacccataaagagatggattttaagacctagcctattaattattaactttaattatttgcttcctaaacattgtgtagttcaagtctagtcagtatgataatttagaagtcagttgcaatagtctgcacaagaagtggtgaaaacttgaactacagcagtggtatagagatggaggaaagagaatgaccccaggaatatgtagggaataaaatagtcaggacttggtgcgttgattgtagatttgaaaattgaaagagagggaggaatcaaacttgttaaaatacctctttattgagcagcacagggaattagtatgtttatcttattgggtcttggaaaaggaggagactgttgcttcatgttgaaagccaagagaataaaaggcagggggagaataagggctggtgggggttgcctttctataaccctccatgagaggtagacatctctctctgtgtcttaccttcctatcctactcactgtactagtggtcttcaaaaacttttttttttttttttggagacagtcttgctcttttcaccaaggctggagtgcagtggctggatctcggctcactgcaagctctgcctcccgggttcacgccattctcctgcctcagcctcccgagtagctgggactacaagcgcccaccaccacgcccagctaattttgtttttgtatttgtagtagagacggggtttcaccgtgttagccaggatggtctcgatctcctgacctcatgatccgcccacctcggcctcccaaagtgctgggattataggcgtgagccaccacgcctggcccaaacttctttttaaagtagtaggaggacccctttatccaaacaaaatcttactatgtaaaaccccaggatatgacagctaaaacaggtgaagggacctgaggcacctccacagagcacctaggactctacagaatagtttgaacagcagtgttgtagtgtgaacacagctgaacttactcctaccttcccaccccaagcttcagataaaagttgatgtcagaggccctgtagccaggggctgagagagtggtggtatcctcagattatagcagtgcacttgcttcagaaatgatttgctcttgaggcatgtgtgaatttaagaaaggtaaaatggatgaagtagttattggccttcatcaatcttaattatcttgccctaccagaaacagaaggatgaattggggggaataccagccagggagtctagaggtctagtcctggctgtgaccttggctggccacttgaccttgagcccatccctgaacctcatctgccttggtttcctagcctattaaatgagaactgggtgatctctgaggtcccttctagctctaaaattctattaatttgaagtagccagctttttgggaaaaggtttttgattgaagatgcagtctcagagattagtgcctgctcatgagaaatgtcctgaaagtcccacagagggaatagagatggagcacagcccatgttatttataaacccgtcttcatcattctctagctagacatagcacacttttggcagtaagtttttagtgggaattttccatgaccttttggggtttaattttggctatatgaacatggtgataatggacaagtacctctgaccgactagaactgcagaatgtatagcaaaagtaagagttgtctgaggtgactcttttgcaaagtttgagagtgtagcccgtgttctaacccccatctctgtcattttttaatttttatttttagagatagagtcttcctctgttacccaggctggagtgtgctggcatgaccatagctcagtgcagcctcaaactcctggtctcaagcaatcctcctgtctcagcctcccgagtagctaggactacaggctcatgccaccacatctggctaatttctctgcctctgtcatgtagggtggcctgctcaccatttctctgctattgctcaccatttctctgctactgcccttctcttccctgggcctttgctgatgtattagttataaatggctgcataacaaattatacaaaatctagtggcttaaaacaacaaacatttattacctcgcagtttctgtagtagcagcttagctgagtggttctggctcagggtctcacaaggttgctgtcaagatgttatctaggggtatagtcatccgaaggttgattgggcttgagcgtctgcatccagccccactcacatggctcttggcagaggcctcatgtctttgtcgtgtttctccatagggctgcatgaatgtcctcactacatggcaactgacttttcccagagcaagaaaattagcaagagaaaagttacaacctttatggcttgatagcagaactcattctccatcatttttcattttttcatagtctttttttttttttaaggggctcactacattacccagacaggctcaagcaatcctcctacctcagcctcctgagtagctgggactacaggctcacaccaatgcccccaaccattttgtcatagtctacttgttagaaggaagtcactgagtatagccattacccaaggaaagggaaattaggctccatcaaagggaggaatatcttaaaatttgtgggcaaattttaaaaccatcacagctggctctgggagtacttttctgaccaaggtagtatcataacaggttttattcaagtgtatatctggttagtcaagaacttagttctcactcacaaactggttcttagagctgggtaactgttgctgtcttattccccccttgaaatatatttaacagttattagggaactggatgaagaggaataatgtgaacatgtacattaatttattcagtaaacattcaccagatgtcactctgcagagatataaaacaaaccacggtctatgtctttgaggaatttgtactagggaaaatagacaaaaaaagaaaaggaaaaatacaatacagtgtgataaatactatgacagtggtaagcacaggatgatttggtacacagagaaggggcacctaaccaagactagggacttcaagaagttaaggaaactttctggaagtggtgactcctgggcgagggcccccacccaccacacaattcagacaagagctttgtggccctgtgcaagaaaggacctcattattctttttaccttacagaatgttgctgaggcacagtgcatcgccaaccaagttcagctcttctacgctactgatcggaaagagacctacgggttagtggagacctttaacctcagaccaaatgagttcaaatatatgtctgtcatcgctgaattggagcaaagcggacttggagcagaactgaaatgtgcccagaaccaaaataagacttagaactgtacaggttggcccttcacctagttgactcagccctcgatagtctagagcccaccccctcctcaggaactcaagagctcagcatttataatgagcagttggtaatgagttgccctatgtgcttgtcgcaagcagtcacagagatgagccctattacttgatattcaggaacaaaggtacctgaacattctgataattatctcagcatacttgaggtttccttttttaagtgttcgaggttataacaagagacagccaaggacctacaagacagttgacttgattttgcacagtgtaacagcgcagttgcattctggccactttgaccttatagctcccaaatgatgagtttgtcatctttatgaactcatgacaggataataagcttgaagacctgctgtagttagatatgggctttaatccttcccaggcaccagtcagctgaacaaaagcataagccaaacatcctgtttaaactgtagaataaccagatattcccatcaggttaaagacttcatctagatgatgccccccagagatgcctttagtgtaagtagctggcttggggtatcagcaaatttcaggtatagttagataaacaggtacagggcctgcatactattaaaccatagtttgtggcacccgcttttctaactccacctgttagaagctatgtgtttgaaggaatgaatcagtgcagtataaataaaattcttttgtaaggagaagattaa

SEQ ID NO: 5 - DNA, 20872 bp, Homo sapiens
aatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggtgagcccacagggcggaaggcgcccagagctcccgcgcccggcccgcgtcccctgcctgggagttggggtggggagacctgcccgtggcgctgctcccctcccagcctggcccgggcgcccggcagatccaccctccttccggtgagcgcggctggggtggggttgggtggggtaggatggggtggagggagcggcggactcctggggcgcgtagaggggcgcgctctgcacctcgcacctccccactcagatccttccctcgggtcccaaacttgtagcagaaccgaattagcgggtggactcgaggacgctgcccctcgcagaccgctccctccctaattggctctgtcaaacttcttcctacttgggggaagtttctaggaaagtcaggggtccctcgcgatcgttggggtccgctgtaagcggacactggctgcggggcccgggcctggggcctctgcgcctgcgggcctgatatagcgggtgattcagggctcaggcacgcaccagcgggggctgtgccaagcggggaacgcgaccgccaacctcctccccagaccctgcgcccccgcgcccccacatcggcctcggcggcccacccctgtcccctcgctgctctctgctcctggccaccaggcattttcaggcccttgaggacaccctcacccgcggcgcgctggcaccctgggcctcctggaagcgggcggggctgggcggggaagagtgggcgtcaggagtgcaagaggggctggtggagtgggtggacagcccctgcggggtccggcggtctgggcgcagtctgggcgaggtgaatcaccccgcatgcctgcgggggcgggggccaggcgcagcagcgcagccggcgggaggaggctggcgcccccaccccccggctccgcccggggccacttgttgctttctttgcagctctccccattcttcacacttggataaaaatgtagcttttggatcataacccccaataaacctgggagtctcgggtttctatgctgctcctctccacgccgcttccgcagtgccatcggggatgagattttgggctgggcggcaagtgttccagcctggctcctccccgcctcccaaaggcctgctgatgctcctaaccccagggaggcgggatcgtgtggggcaggggggttagtctatgctcccctctccccttcctctccctgctgaagggaatggaaagaaagggaaggctggatttcccacaccctccaagttagaagacccctttccgggagttgtggctctgctgactgctctggggcctggtcgagccgggttctgagtgaccatctggggtgaggcgagggggtccttggcttggtttccccaggaggagttaagatagatgcaaatcaggacaagtatctgggaagagtagagacagaaaggtgggtcagctggtacctatctgaggtggtgggacagaggcagaagtggcacttgtccccctccccacccttacccacggatgacagactcctcccaggaggcatatacgtggcttttaaaagctttacttcccctacttaagcactatttagatagaaaatgtttgcccagagctatttccacttagtctaactgcttggaggacgcaggatgagaggggggcttttgacgttttttaagagacctgcttagtactggggacattgagaggagcggaacaagacaggggtctgggacagcaagccagctctatatttcctccagagcctggtgtggccgagagccaccatgaagagctcgaggggtgacccttctcacgctaactatcccagaccatagaacctgggaaaagtcttggcctggaggtaaacttccctatgccaaagatggagattctgagagaagagggaaaggtatggagggagaaagacttatctgcagaggccactggcatccctctgttctgccctctccagcaatctgcagggatatgtctatattttagggggtgggagggaatgtgttctaatcacaggtggcttcaaatgaatctgcactaaaccaaggccagtgggtgacagagagttgaggtagtaagagtagctcaaatggagtcccaaacccacagagggaataactaagaactgaaatggtcccaacctggggaagacttcagacgtaaggaaaagattccagcaaatggggtgaggcttgggaaagcagaacttccctgagctgcagagcagatgttccaggtggggacccggctgctggaggaaagcagaggctgctcctgctcctcccagaggtctgcaggcctgagaagggaaggaggtaaaaatagctctgtgccttggcaggcctattagggaagattgggggcagcagcatttatggtaaagtccggctgaagggggaggatgttgggtggccaggcaaagagacagagatttggagaaagtttcctgggatggtgtgaattctctggaggggccataggggaagggatgctgtattccccactacaggggtgggaggtgatgatgtggcagtgggggcggggcagagaacaccaagggatgggaaggcccccgttgtgggatggagacatctggccttccataccctattcctggggagaaaaggagggaatcccttgtatggccccaccccaaattcagggaacttctagacttaatgatttcacagctttaagtttgcatttgaacacacacacacacacacacacacacacacacacacgaaattcagcacctcccaccccaaggtatcacagccctcatcttaaactcacttctgagtcattactgcccttctctggcatttccttccctgtctcccaaacaaaacctagcagtttgacattgcattctatcaggcgacacttggctagcaacagctagtaaatgagagaagtgaattctactagttataggagttaatggactgagggttgcaggacgatcaggccagattgtgaatatagaggcagttgctctaaaataccatgcagaggccgggctaggtggctcgtgcctgtaatcccagcactttaggaggctgaggcaggtggatcacttgaggtcagtagttcgagaccagcctggccaacatggtgaaacccctctctactaaaatacaaaaattagccgggcatggtggtgagcacctctaatcctggttactcgggaggctgaggcagaagaatggcttgaacctgggaggcggaggttgcagtgagcgagatcgtgttattgcactccagcctgggcgacagagtgagactccatctcaaaaataataataataataataataacaacaataaataaaataaaatgccatgcagatgagtggaactatgatcattaaagaaccaattcttccaggcaacaatttgttttttggggttttttggttttgtttttcagacaagttctcactctgttgctcaagctggagtgcagtgacacagtcatatcttactgcagtctcgaactcttgggctcaagtgatcctcctggttcagcctcccgagtagctaggactacaggtgcccaccaccgtgcccggcaaattgttttttttcatatttgtagagtccggggtctcacttagttgcccaggctgatctcaaactcctgggttcaaacagttctcctgtctgggcctcccaaagtgctgagactacaggcatgagctaccacgtgcatccagtttgtttatttttaaacttaaaaggctttatttttaattactatggatacataatagttgtacatatttttggagtacatgtgatatttcgagacaagtatgcaatgtataatgatcaaatcagggtaattagagtatccgtcatatcaagcatttatcatttccttgtgttaggaacatcccaattccactcctttaattattttgaaatacgcaataatttctgttaactctatcaccctattgtgctactgaacgttagatcttattccttctatctaactgtatttttgtacccattaaccatccctccaggcaacaatttggagagtagggctcttttagatccagaaagtggggataaaatggaaatacggggctgggcgcggtggctcacacctgtaatcccaacactttgggaggctgaggcgggcggatcacctgaggtggggagttcgagaccagcctgaccaacatggagaaaccccgtctctactaaaaatacaaaattagccaggcgtggttgcacatacctgtaatcccagctactcaggaggctgaggcaggagaatcacttgaacccaggaggcagaggttgcggtgagccgagatcgcaccattgcactccagcctgggcaacaagagcgaaacttggtctcaaaaaaaaaaaaaaaaaaaggaaatacagtcacgcattgcttaatgactgggatatgttcagagaaatgcagtgttaggccatttcctcactgtgtgaacatcatagagtaactttacataaacctaaacagtatagcctactgcacacctaggctatatgatacagcctattgctcctaggctacaaacctatacagcatgttaatgtactgaatactgtaggcaactataacacaatggtaagtatttgtgtatctaaatgtgtctaaacatagaaaaggtgcaatagccatggcacggtagctcacacctgtaatcccagcactttgggaggccgaggcaggtagatcacttgaggtcaggagttagagactagcctggccaacatggtgaaaccccatctctaaataaaaatacaaaaattaggtgggtgtggtggtgggtgcctgtaatcccagctacttgggaggctgaggcaggggaatcgtttgaacctgggagatggaggttgtgcctggacaagagagcaagactgtctcaaaaaaatagtatagtatagtaaatacataaccagtaacacagtcatgtcttatcaatatcaagtattatgtactgtatataattgtatgggctagacttttatacaactggtagtgcagcaggcttgtttacaccagcaatcaccataaacacttgagtaattcatttcactaacacattatgatggctacaatgttattaggtgataggaattttttatctccactacaatctttttttttttttttggagacaagttctcgctctgttgctcaggctagagtgcagtggcacaatcttggctcactgcaacccctctgcctcccaggttcaaacaattgttcttcttcagccttccgagtagctgggatttacaggtgtgagccaccatgcctggctaatatttttgtatttttaatagagacagggtttcaccatgttggccaggctggtctcgaactcctggcctcaagcaatccacctgccttggcctcccaaagtgctaagattacaggcataagccaccacaaccagcctccattacaatcttatgggaccacggttgtgtatgccgtctgttgactgaaacgttgctatgcggctcatgactaaaaatgtgttctggagcagttttgaggaggcaaagtcagtgacctacatatggaccagcagcaaaggcccatcagacctgctccaagtgcctggggataagggccaggaagcatttaagggattaggtgtctcatgggcattaaagggtagggcaccagggctggaacgagagcctgatggcttctcctccccaaatcgcaatccaacctgtacctctttcctggattcaacgcaaattagggctaccttgctctagaagaaccccaaacctttgtccaaaaatattctcaacccagggctttggtccctttcatccctaaaacccagcggccatggagagtatgcatagtacatcccttcctcccaaactgagtttgggttgtttttcctggtcactgggtccaaagcagggagggtatttttaggggtattcccaagacgaaaggaaatcatgctatccctgggttcctccctccctttttttttttttttttttttttttgagaaaggatcttagctctgcagcccaggctggagtggtggtatcatagctcactgcagcctcaaactcctaggctcaagcaatcctcccatctcaccatctcagcctcccaagtagctggtactacaggcacaagccaccatgcccagctaatttttaaattccttccggccttctttccttcttcttttcttcttttctctctctctctctctctcttctttctttgacagagtcttgctctgtcacccaggccggagtgcagtagcgtgatctcagctcactgtaacctccacctcctggattcaagcaattttcatgcctcaccgtcctaagtagctgggattacaggcatgtgccaccacacctggctaatttttgtatttttagcagagacggggtttcaccatgttggctaggctggtctcgaactcctgacctcaggtgatccacctgcctcagcctcccaaagtgctggaattacaggtgggagccactgtgctcagcctaaatgttttttctagagggtccccactgttgcttaggctggtctcgaattcctgggcataagtgatactcctgccttggccgcccaaagtgctggggttacaggcgtgagccacgcggcctttttatttttatttttcatattgtaaagatcaaagtcaaaagcatgaggagacagcaaagagtgggcaactgatagcaagaggggaggggatattattgctaagcaactaacctcagaagtaggagtggcttgggccatttttttttggaaatataacattgtgaatatttcatcattctgtcattagcattttttaaatttttcttttctttttttctttttttttgttttttgttttgttttgtttttctgagacagggtctcactctgttgcccaggctggaatgtagtggcagctgtcacggctcactgcagcccctgtcgtccgggctcaagcattcctcctgccttaggcccccaagtagctaggactacagacatgcaccaccacatccagctaatttttgtattttttggtggagatggggtttctccacattgcccagggtctccaattcctgagctcaagcaatccgtctgcctcagcctcccaaagtgctgggattacaggcgtgagccaccgcacccggcctcattatacacttcttgagctagaagacactttgcaaataatcaacttcaactccttcattttgtggtttaggaagctgaggcccagagaggggaagtcactagcctattgtcactcaagtgattgggagtcaaactggagccagaacccaggtgtacccttccgctacactcactgctccccaccccctccttccgttctgggctctgcagcagaaagctgagtgaagactagccctgacaaagctagggctagctgtggctccgacacttgctgagggagttagttgcacagtcctggccctggggctgctttgcgtgtgtatgggtgtttgtgtgtgtggcgttggctatgagtggccagcattggtggccattggctgcttagccttgtaagtgctgaagtagaggcaatgtgtggtcacctggcctggtgacagtgggaggggagaggtgtaggggaggggaggggtgtaggggagaaaagtgggggaaaggaggggtgttggggaggggaggggcgtaggggaggagtggagctcctggtcagccgtggtgtgccctggcagggactccacacatacctaggagagggacatgttgtttccctttctcttcagcctctctgccactcccacctcctccttgtaccctgcaggggaggttgggacctgctgctttgtttttttgagactacaggctttatcaaatactgctattgcctgagtccaatagtgccgccaagtgtccctctcgcctggcatctgattgctcaaagcaagaagcctatagtcttccacaactcagcccctcaggagagagagttgggggctgccgcagaggtccagaggtcccaggacataggctcacctgtcataaaaatagcttggttttgccaggcacagtgatgtgtgcctgtagtcccagctactcaataagttgaggcaggaagattgcttgagactaggagtttgaagccaggttggacagcatagagagactctatcttaaaaaaaaaaatagagcttggttttggatcctgatttctctgtgcattttagtgtatgatatcttaagtggtagcaagagggaggggtggcaagggagacagaaggtggggacgtggccaaagggaaattgccaggatgtccctcttccatgcctatccctctcctcatttggggtagcatcctgtgtccaccctaccccagggaagaatgaaaacagattaatctgggcacactggctcatgcctgtaatcccagcactttgggaggctgaggtgggtggaccacttgaggtcaggagttcaagaccagcctggccaacatggcgaaactccgtctctaccaaaaatacaaaaaaaattagccgggcatggtggcacacacctgtaatcccagctactagggaggctgaggcaggagaatcacttgaactcaggaggcagaggttgcagtgagccaagatcacgccactatactccacagcctgggtgacagagcaagactccgtctaaaaaaaaacaacaaccacaaaactgggattggcagagtctgactctgaagacagtgaagttgtgtgcctttgtatttactcatctgagcctccccagttataatccaacaactagccccttagaaaactccttatccacccctagtagcctccatagtcttcctatgattatggctggggaaggattggagatggaagcccaagaatgggactggggaatattgtagagggaggaagggaggggctcaattgaagctgtgtttattaattcttgggcttgagtttgccccaccccttttggccccagggacctctttttttttttttttttttttttttttttttttccctttttgagacagacttttgctctgtcgcccaggctaaagtgaagtggctggacctcagctcactgcaaacttcacctccctggttcaagtgattctcctgcctcagcctcccgagtagctgaaatttcaggcatgtgccaacaggccccactaacagtattttttgcagagacctgggcaatgttgctgaggctggtcttgaactcctgggctcaagggatccacccaccttggcctccaaagtgctgggattacagggattataggcgtgagccactgtgcccagctcccagggccctcttgatgaagcatttaaaatgagtttctaggccaggcatgatggtggctcatgcctgtaatcccagcactttgggagcccaaggagggcagatcacttgaggtcaggagttcaagaccagcctggccaacatggtgaaaccctatctctgctaaaatttcaaaatattagctgagcatggtggcacccacctgtaatcccagctacttgggaggctgaggcaggagaatcgcttgaacccaggaggcggaggttgcggtgaaccaagatcagagatcacgccactgcactacagtttagcagcctgggcgatagagagaggctccatctcaaaaaaataaataaaatagtccaggcgcagtggttcccgcctgtaatcccagcactttgggagaccgagacaagaggatcgcttgaggccaggagttcaagaccagcctggccaacacagtgaaacccggtctctactaaaagtataaaattagctgggcgtggtagcatgcacctgtaatcccagctattcgggaggctgaggcaggagaattacttgaacctgggaggtggaggttgcagtgagccaagatcgtgccactgcactccagcctgggcaacagagtgagactctgtctcaaaaaaataaaataaaatagtttctagcctgggcaacatagtgagaccttgtctctatcaaaaaaaaaaaaaaaattagccgggtttgatggtacacaactgtagtcctagatatttgggaggctgaggtaagaagattgcttgagcccaggagttggaggctgcagtgagctatgattgtgcactgcactacagcctgggcaacagagcaagacccccatttctaaaaaaaaaaaaaaaaaaaaagtggtttatttccatcctaatacattgtgctcccctccctactcaccagcccctactctgcatgccaccaaggcccttttttctcaactccttttgcacccaccccaagccccatttaaaccccttttcctcatcttagcccaagaagaagccgaatgcaccctctgacctggccacacccaagatcgtgccttttgacctgcctgagactgagccctttgacctgaagcctgagacagtgcctgagctcccaccttttgaccagacgcctagggcactgccatattacccagagcctgggccccggcccaccccagaggagctgacagccggtgggagtgtttagggtctcccggatcccgttctgtgggcgtggggtatctcttcagtccactgtcagcccacagcctagtggtgatcactgccaggagggccaccatccccagtcactgcccactgtggacgggtgccgggtactgtgagaacactggcgttatgcaaagttcaggagaatgggatgtatacagtggggatgggaggggaatggaaggggcctccccacttcttggtttctgtttttagtagtaaatgctcccccacacttaagctgcacccgaaggctgcctagcatgaaggcgcatggcttctggttctgccgttccccctgctgcctcctcctgagggacaacccagtttggctcaaagcctctttggagagggccatcatgaggctcaggcctggggtctgttctgtgccctctccacccactccctgcagctgaggaaaacatttacacgtattttctccagtttcttttagaaaatgctttgcaaagagatcgcttatgtttgccagatcctgccttgggtggggtgcccaaaagctgccaactcacagatgccaggagggggacattctagctggctctggctcaggacctctggccttcctatagcagagtgtttctcaacttaaaaaaaatgttaaaaaaattttttttagagatggggttggactgtgttgcccaggctggttctgaactcctggggctcaagtgatcctcccacctcagcttcccaaagtgctgggattacagatgtgagccacctcacccagccagtttttgttgttgatggttgttgttgttttcataatcactcccatatacagaccttttagtttttttttttttttttgagacatagtcctactctgtcacccaggttggagtgcagtggagtgatctcggctaactacaacctccacctcctcggttcaagtgattctcctgcctcagcctcccaagtagctgggattacaggcatgtgccaccacacccagctagtttttgtattttttggtagagacggggtttcgaactcctgacctcaggtgatctgccccgcctcccaaaattctgggattacaggcatgagccaccacccctggccctttcaattttttttttttttttttttttttttttttttttttttgagacagagtctcactccgtcgccaggctggattacagtggcacgatctcggctcactgcaatctccacctccctggttcagcctcccgagtagctgggattacaggctcgtgccaccacacccagctaatttttgtatttttagtagagacggagtttcaccatgttggccagaatggtctcgatctcctgacctcgtaatctgcccacctcggcctcccaaagtgctgggattacagccttgagccacagcacccggcccctttcagatatttttaaccaagctgttcatctccctcacgaaatgttaaaacaatagataaactgtatatctgtttatgtactgtggctcttgggagtggcacaaatcattgtgatatctaagtcccctcccaatctccaagaatcagttttcacccttttggatgcaatttcacccctgccaagaatgcacgctagagcagaagggagggacacttctgcccttggggtctctcatctccttgtcttagcaacctctagcagaggtcctgaattttaaagacgttctctccccttcacctctcccctcctctgcaccctcttctaacatacactctaagcagatcctgggtctctgaattacctctccagtctcctccagccattcccaggcagtggttggggacctagagctggtcagccttaagtcaagagagcctcctacccagacccatgtggcatctgtcccttctccctaacaaatgtgaagtgcctggccaagggccagatgtgtaataggtgctcaatgacattataatcttataaaaatcttcctaagccagatctcgagtttagacagcagggttggggggtggagtggaagaggctgggagcctccctgtggctcctctgcatccatcgaggattgaggagctatgtgtgcttggcaaagggcagggggaactgtaatgcttttgttcagagctggtcattaaaggtaactctggaaaccaagcctattgggagtggtggttttgtttaataaaaacgagaaacagaacaagcagagccgtccctccttgccatcccctgaggtccttcctttggcttaggagctctgccagagaagtaggggtgggacaagggtgcctggcctgtgtgcccagggtggagggagatgattttggattgtgtttgtggtggttgtaccagcaagcagatgggtgggaccaagacagcactccaaggctgtgagtcatgggggaaacctggcctggagtggagaggaaaagctaatggtgaaataccctctccagagccagcctattggacatcatcccaggattcagctcaagttgtttcgtctcctgtcccctgaccttccaccaagaaggcagctcctatggtgtaagccgtcactccaggggaagcctacgatgaatggggttagagcccccagatcccttactggtctggagagatttctaaatccaggaataaacctccccttggccaggcacagtggctcatgcgagaaatctcagcactttgggaggccgaggcaaggggatcacttgagcccaggagtttgagaccagcctgggcaacatagtgagactctgcctgtacaaaaactacaaaaattagctgggcatggtggcgtgcgcctgtagttccagctacttgggaggctgaggtgggaggatcactagagcccaggaggttgaggctgtagtgacctgtaatcatgccactgcacttcagcctggttgacagaacaagaccccatctcaaaacaaacaaacaaaaacacaaaaatggccagatgcggtggctcgtgcctgtaatcccagcactttgggaggccgaggtgggaggatcccttgaggtcaggagtttgagaacagcctggccaacatggtgaaaccctgtctctaccaaaaaatacaaaaactagccaggtgtggtggtgcatgcctgtaatcccagctacttgggaggctgaggcaggagaactgcttgaacccaggaggcagaggttgcagtgagccgagatcgcgccactgcactccaacctaggtgacagagtgagaccatgtctcaaaaaaaaaaaaaaaaaaggccgggcacggtggcttaggcttgtaatcccagcactttgggaggctgaggagggcgaatcacatgaggttgggagttcaagaccagcctgatcaacatggagaaaccccgtctctactaaaaatacaaaattagccaggtgtggtggcacatgcctgtaatctcagctatttgggaggcccaggcaggagaattgcttgaacctaggaggcggatgttgcggtgagccgagatcgtgtcattgcactccagcctggggagcaagagcaaaactccatctcaaaaaaaacaaaaaaactaaaaaacaaaaacctcctctcactaggattgcttccttatgttgtagtttgagacctttcatgaggcactaggaagatggcattggctataagaagtctgcagctctctccccagtcccattcacttccaagttcagctggcaaagacctttatctaggaagccacaggccaggaaaaccagccagctcagcctttaggggtggggtggagcaggcagcaggggtaggggagaagcgggggatgctgggggtagggcagagagacaaagtggatttgttttccagcagctggggctgtttcctgactattccctgcctgtcacccttaatccctccctagcctattcacattgtctgagtttagtgaaaggaggggctctctccaccctttggtggggcgtgggtgggtttttaagtctgggaggttatgaaggaaagatcagagctgaattttttttaatatatatatatactggggctgcaggtaaattctgggtggagatggatgaagagggtttagatcctacaatgatgtataagtcttaaatgatatgcactccagtagcaggcagggtaagggtgattgtaggagccccaaagtgaatgactggaaatcagagggaatgcaaagagaagttgagactctcctacactcagaacaaggaaaacacccttcaatgcctcagtgaatgataagaggcagagggataaacaaaatgccctaggattgcccatgatctgcactaagccgtctatggcaggtagagactacaagtcccagcatgccctgtgcccaggtcaccttgcctgctgggaggtgtagttgggtaacagagagctggaggtggcttggtgcccagcagagctgatgcccagatgagagaagaggtggagccagcattccctctttgtccctgctaatgctattgacaagaagggaaggaagttgggagagggtgttcctagttttcagtgtaaaccaggaaactctggggggatgttgatgggagggaagaggaaagaggttgggggctggggaaggaatttctgtagcaggtggtgcagagataccgagcagcctatgtataggggtgtgtgtgtgtggtgtcagtgagaggactcagtttatgttgccttaatttcttaggggacaggatttttcttataattctgggaaatggtcttcagaaaaccctttagaaaagcgactatctctcgttccttcatttgaagtcactaaagggagtctgggccaaagagatcctattgatgatcttggtctgccctttccctttctgtgctcagcctcccctgctctctgatgagggtggaggtgggggagggagtgatccagagattctgaaatgttggccagagtcaagatcttggaaaatcttcccggaatggaaagcagttctggtgctaagtcctccaaggagaagacagaaaagcaaagaactggttctgagctccagggtcatggggaatctgagaccacccatcctactcctagacccctgagctcaggctttgtgctgggggcagggggtagggaaagcaagaattgaaaagtaatctctcttctatcccaaagtagggaagtcacaaccagaagaaatgtccagactggggagaaaacatgtccgtggctcccagccagcttcttcctctttccaatatcaatttctaaatgtgggggagggggagaatgaccactggtggagccaaacagtatgaaggagtcaaagaaggtggaggtgggggagggtggaccacagttctccatctctaaggctggttctgaaatagcttgaggccaggagcagtggcttatgcctgtaatcccagcactttgggaggccaaggcgggtggatcatttgaggtcaggggttcgagaccaatctgaccaacatggtgaaaccccgagtctactaaaaatacaaaaaaattagccaggtgtggtggcgcatgcctgcagtcccagctactcaggaggctgaggcaggagaattgcttgaacctgggaggcagaggttgcagtcagcagagatcgtgtcactgcactgcagcctgggcgacaaagcgagactccatctcaaaaaaaaaaaaaaaaagaaatagcttgagtctaggaaatgcacttcctttactttacctgcttgggtgggtaggtgcagctgtgggctcaaacccctacccgctttcaacttagacactcccaccacttgcttttcggcctggctcgggcagtgtgcgatttgcggcaccagagggcgctccgcccatttccaaagtggagctgtgtctcccgagggccgtagtggtttaatatcatctacgggtggaaagggatcaggacagggttggacgaccacagagattttagcccaagtgcaattattacgcaaccccatctccgacccgaagtttggtcccctgctcccgcggtctgtttagtcaccattcgttcaacacacatgttttttagagaatggcggcgcgaggccgggcgcagtggctcacgcctgtaatcccagaactttgggaggccgaggcgggcggatcacctgaggtcgggagttcgagaccagcctgaccaatatggagaaacaccgtctctattaaagatacaaaatttagccggcgtggtggcgggcgcctgtaatcccagctattcgggaggctgaggcaggagaattgcttgaacccgggtggcggaggttgcggtgagccaagatcgcgcccactgcactccagcctcggcaacagatcgagactccgtttaaaaaaaaaaaaaaaaaaaaaaacaaggagagagagagagaaagaatggcgacgcggggttggggggccggagatgggtgatatgttgcccaggctggtctcgaactcctggactcaagccatcctcctgcctcggtctcccacagcgctaatattacaggcgtgagcctacacacatttattgagcgcccgccagtttcctggggaccacgagcgtcccatgctcccctctctccaggatcgtcaccaccctgactcaggctcgcccacatccgcctcctccgacgcctctcatgtcccttctcctcttcccttaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacaacccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgatacgctgtttaaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaagga

SEQ ID NO: 6 - DNA, 170745 bp, Homo sapiens
tgcctcccagcctgtgcccccagcctgcgtgctgcccagagcccccatagagagaggtgaggagacagagccgggcagggtgggggctgttctgtgccctggagggtggctccactaaaggtcatgtctggggagtggggaagccttcagggtctggccacagtgcagctccctgtggcggggctggggttccagcctctgctccctctgagccccggagctgggctgctcacatggggatggagccactaggctggcctggggctgcggggtagccggggcggtgccctgcacccaccgtcccctctaccccggagttgacccttgctcagagagcggcctgggggtctggctggccctgcccccagcactgctgagatagatgcccgctgacagctggggctattttaggcctgttggctcagcagaggggacagccagaggggcgctgacacctgactccaggaaaaaatttccccagaacgcttgaagcctccggtggggtctaaggtgaagcacagccctggggcgctgcccttggaacttcatgctggaagggcacgggagcacaggctgcccaggttgtctgtcagtgtaggggtggggagggccagcgaggtggcaccctgggagctgcctcccactctggactcttccctgtgatggtcccgggcccctggaagaccagagtggcaaagttctgcaacagtcagggtggaggggctgctgaggggtgggcggctgtgggtggggcctgtcacccggggcatggtttggtggggggggggggagcgtcccacagcgttggaatgaggcctcaaggggctgaggagcccaagtgtggtccatggtgggtaaaaggctttcctgggaggctgaagtctccccctcctggggaagctcgtggggtgcccagacccaaaacgtggcagagaaaaaagacagcctctgcagatgtcccagtgcccgatggattcctgggagccccacgggtgaccgtggtggcccccttcctgctcggcctgtttcttcatctgtgatacgggttgtcagggaggaggatgactcctgaaccctcaagtgtctttgcttggtgagcccctctctggccctaggcctgctgaccggtggggacgcctcctgatggggctgccatgagccccccagaccctgcagtcggcctcctgggcctgcaccaggcgacagaatgcagggctatagtgccgtccctggcagctgatgaggacctcagtctctacccgctcttcccaggccaaggtcagcctgtgcacctctgtcccttcagcacaggcagtaacgggagctccctgacctgtcccggtcctctaggcccagagaggctacccacacatgctgcctcatctgttccactgtgaccctggcagggccagctggggatctgggtgtggcagaggttgggggagaggatgccccgttctgcttttggggaacccacagacctgctatatgattttttttttttaagagactgggccttgctctgttgcccaggctggagggcagtggcatactcacagctcactgcagctttgacctcctgggctcaagccatcctcctgcttcagtctcttgagtagctgggacagcaggcacctgccaccatgtcgagttaatttgttttaattgtttttgtagagatgggggtctcacatgttgcccaggctggcctcgaactcctgggctcaagggatcctcccacctctgcctcccacagtgctgggattacatgtgcttgccaccacacctggcctgactgtatgactttggagagtgctggggacagcccagagctcatgggccctgcagagttgatgtcaaagtagcccttttgagtcctgggaggagcccatagaggcaaattcccagaaagggtgaaactcggaccccggtccctgctgtgggcaggcccctgcccaggtcctccccagccccagagccctgctgtgggtggggaggctgggctgcagcataggtgctgcctgcacagtgagtcagcagactggtgcccgctgcgcagtccagccctgctccagcctcagactgcccaaggggattaagggggattaactacctgaatcacaggaccaggaggagggcctgggaacgttgccctggctcagcccacagtgggcagcccaggcccagaagctggtggctctggcctgagagagagtacaggcgaggtgccctggcgggggcctctccaccatggggtggttgtgcctgccagggctggagggagttaaggcgccccgggccagcccagtgccagtggggcccactcacacccgctgttcctacagaagagctgcataggcacggtagtgtcaacccacaccatctatatggggggatctgtactggggcggctggcctgctgggctccgcctggggtggtcaaaggacagcatcacctggggcctttggcactggtgtccaccctcagccctgcagcatgtccagctggccagtgtggctgagaactgtggggtgaccaagttgggcctggctgacccagcccagctggtctcagcctggaggtctctagcccttccagggggatgttactggccttgccagctccagactctggggtcccccagctatgctcccaagccagatccctgactgtgccctgcccttgcatcccaatcccaccctggggctcagtgggggggcctgggagcaagcagctaagtggtttccagtccttcccgctcatggataaagagcatgcccctggggaggagggaggtgtgtgaccctgcagaagaggtgaggcccctctgcaacaagggcagcttcaggccggactggcccctcagtgcaacctggaggggctgctgaaggagagctgcgtaggggtcggggggaagaggagggagtaagggctttgcccagggcggagggtgcatctcacctagaagaggctcaaaggggagcctgccagggtggagaaccggtgacctccttgtgcgataggcagaggagacgggcatgagaccggtgcccatggtgggcctcctgcacccaggcctgccggggctcagcgagcctccccttcttgatgtgggggacacacaggccagctgaagttttaggcccgagaggcagcagtgtgtgcggtaggagaaaggataccaccccgcaggtagggagtggcctacagtgcaccaggcaggtctgcctgcctcaggaaggtgcagcaaagcttgtaggctgggaggaaccaaaaatagcgggcactgcgagggagggggccctgcctggttgctagggggtgtaggtttgggacatgtgctccagtaactgcagctgaggcagtgggtccctgtaggtagggagagggaaggagatgttctcagcggctagaagagccgtttgcaggtgaggttaccaaaccccaaatgcccagaaaggggcaagtctgcacttctgggtcacggtgccaaccggtgatgcttcctcagggcgcggggagtgggggggaaataggatgtgtggaggtgttgaactgggttcctcaggcggcacggtggggtgcacccgggcctcattccaatccccactaaggccatccccacctacttgcaggtccccgccgccaccctcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcggtgagctcctgggtgcggggcgcgcgggcccaggctcctccgcaacccgtgcacctgggtcctttcgcccttgcggtctgccgtttcccacccgcgtctgtccggtcgtggaatccagggttgcaggtgtccgttcctggtgcgcaaaatgcgggcgacgccccacgacctattctaaacacccgcaacccgctttccccacccagtcccctgcccgccccgccccctttgcatgccgcgcccccaacccgccaccgctggcccacagacaggggcgagaggtgtgagaggggcggggccgcaggggatcccacctcctcagccccgccctctccctcccgctgctcccaacccaacctccaccactctgccttctgctcttctactcccccgccccccaacttcctgtctcctcccctgcgcccttcccaacccttagcccctctgcctcctgctcgctcctctccccagcccactcctctaccctgcaccctctcctttccagcctcccagcccctctgctcctgtcccctattccttcccacaccctcacctctgcatcctccagtctcctttcccgcccacaatcccccaatttcccccttcccaccccgccgtcgtcctgcaccctccggccccgcccctctcaccagtcttctctcctggcagagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggcaggcggggcggggcacggggcggggcacagggcggcttcggggaggtagcgggggcaaggaggcaccgagaagggagccgggggcgggggaggggggagccaggccgcacgggctgggcgggcacgggggcgggcagggtgcagacggactgggcttgcgaggtacgagttgggactggggcaggcaggggcgggactggggcgggaagggcaggtaaggtgggggcggaggagcaagctcgggccgggcacggggtggtgattagggggaaggggagacggagtgggcaggggtcttgtgggaccgagctgggacttgggccggcgggacaggtaaggggttgcgcgggggagtgaatcggaggcagttgggaaccgggagacagggggcaagcggaggagcgagtctggagcggggcgtgcaggggctggtctgactggcccggctccctccaccccaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactaaccatctcccagtgctgcctggaggatgtgggccaggtggcctttatggctggcgactgccagacgtccacccagttctgcgtgtcgggtgagggcctgagggtgctcccaggatggcatcgcttccctgctgtctccctggtcccagtcccctgccctccattacctcagctctctgggcttcagcctgctgtaccgagggccgccgggcaagaccatagccctggccctccaacgttaggctccctgagcccccgcgcagtctttcagctgcaaccagagaagtggctgcaggtctggggctggaggttgtggccagtggtccaggtccccagagcagccccaagagagctggggatcctgtgacacccctccaggtgattccagacccagggctcaggaagaggctcccagtagttgacctctgcccaccctctacacagcccccaggaagcctcccctgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctgggtaagtgggacctccctgttacaacctacggggctgctcacctgccccggaatcccccaggtccagcttcaggggaggccagagtggcctcatggggaccttctgtggggaggggggctgccaaggccttgccctggtgcagtgtccgtggtgggaaggataggtgaccccactacagggcccctgggagcctgcctgtctccagcagacccaggggacggggctccagggctgccccactctggtggggcttgtaggatgctggaggggtctcagggcagctgtaccttgtccttgttccttcatgagcctgactcatgctatggtcgctctgtgtgttggctgggcttcctggaggaggaacatttaggtctaggctctgtaggaagagaaggggaaggcagagacctcctcagcactccccactcctcctcggcccctttctgacgctgcccgccccacagcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccggggtaggtggagggccccagcttgggaccctgagcctcatttctccagggtgggcggtgtcagggctccaggtagggctgctacaggtctgagggccccaggacaccctgtcagcctgcaggtcactgggatgaagcaggcagggtggtgggcgtgtgaggactcacccaggctggctggtggcactggtccctggtgtctgggtgagggcctggggctgcaggggtcctgctgggcagagcctcatgtctgtctccccactttcctcctttccccctcctgcctcctctatcttgttaatcttttcccttccgtttctttcctgcttttttctgtctctgccatcccatgcctggctgttccacctctgtctcccctgcttctctggtgtatctgtgacctctgttctgccattgtctcccctgcctgcctctccctcgctgtcctcctgtgctgttctcctgggtccctccctttatctttctctgccccgtgtctgtctctccttgtctccccttccgtccattcccctctgttcacctttctgtgcccctccgtccattcccctctggccacgcatacctggcccccagcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggtgggagcagctggcagcctctgcggggttctctgactttgtggggagggtgagggacagggcagtggaggcgagcccagcttggtagggggagggactccataactgggtggttgctctggtgggcacaagtcccaaggttagagtcagtaggccgcactggctgcttgcccaagcagggtccctctagcctggtgagcctgggtgtcctgtgtggtcccagaagccggaccagctccagcttgtgagcactgtggccaagtttgtgctcagggcctctgcagtgcctgacccagcctgtgtcctgcaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctggtgagcacgctgtgtgtgcatgcgtccaggcccatgtggggtggggagcaggtccggctgcctccagcagagcaggattgaccttcctgacccttcttttctccagcaaatggttgacagtgtcaactgaaaaaaaaaatcaaggttttaaaagaattagttttattcagaaggctcgaggattgcggcccaggagtctttcagactttctgttaagctgctccaaagcagagtttcagtctgcagctcatacataggtggggaaggctctgcagctgctcagaaggtacctttagagccagagctcctcacagcctgggtgcaccttgttacagatgacagaggcacagtcatgaatactgccagacgttatctcatgtgcagggagaagaaggggccagcaccattgaacttacctttcctaaaattgccgtacttcaggctagagacatgggaacctgcactgtgtcccccagggctgcactcattcaccgggccaggattggtgaattctgctggcagaccaggatgagcaaacacagcttcttatgtttgctgcctcgtcccagagaacatttgcttctctgtttgggaaaagaaatgactgactaacttcttctctgtttgggaaaaacagagttagactaactaactaacttctctgtttgggaaaaactaacgtttacgtgggtaaagaatctaaatgtagaaaataagaaaagataacatgaaggaaattgtggaaagtggacgtggacctggttttcttaggctttaggataatcttttccatctgtacatgggcctctgtctcctgctgtgtctcgtcctcgccgccagggctcactcacagctctgcagacgcttttgtgtattgtgtgtttgtgggccagggttagggctggcacttcatttaaaatgtgtttttattttattttgtattttatttattttattattttatttcttttgagacagggtccgcctaggctggggtacagtggcaccatctcggctcactgaagcctcaacttcgcagactcaagcaatcctcccacctcagtctcccaagtagctgggaccataggcgcgcactatcaagcccagctaatttttgtattttttgtagagatgaggtcctgctatgttgcccaggcttgtctcaagcaatcctcccagctcagcctcccaaagtgcttgggccagaaatgtttctaaagcccttctcttcgtttttaggatgaggggactgaggttgagcagagccacagactggagtgtctctgacaggttaagatttgaatgtagggggctctgagccctggctctttctggaagcctcctgggctcagagatgttggctgggaggctgaaggaggagcacagagggcttctcaaggagcatggctgccgggcctctgtgggccggattccgctcacagaccccacaacagggaaggccccaaggccaggctctggaaaactatccggctggcttccagggggaaatatgtgggcgtttaacatataaaagtttaaaaatcatgccagcccagccctcctaactttcacagtccaatggccaattcatccacaatgtagaacacaccctgtgcctgctctctgttgtttgaataatcaggggagtgtctgtgaagctgaaccctctctctgtcttggtccacatgatggcccgtgtccataggcggtggacttccaggacaggcagaagtttaggggagagagagacagcatgctgggtctgcgaaggacactcaggccaccaggccctattgatagcttctcgtaggcacacgccctgccctcctggcacatgccagggccctcactgggcaggggttgggcatcacagctgcctgtgcatgggaagagctacgcctgagcacacggaccatggaggagcccatggcaggactgttcgtgcctggggtacagaatctgataacctgaaccaggccctgcaaacctcacttggaagggcctctgaccccacctccccccttatgcatcccagagcccaaggcggtgtttgccaaggagcagccggcgtgcagggaggtgcaggctgaggtgggggccagcgccacgctgagctgtgaggtggcccaggaccagatggaggtgacgtggtacaaggacgggaagaagttgagctccagctcgaaagtgcacgtggaggctgtgggctgtatgcggaggctggtggtgcagcaggtgggccaggcagactccggagagtacagctgtgaggccaggggacagagggtctccttccgcctggacgttgcaggtgggtccctagtggcatggtcagcacctgtccaggcggtggagcatgtgctgcactggtactcagcacctctgcccctctctgcgtcacctgttcctggcctgtaagggatggctgtgctgcccgcagtggttctgttagaaaatccagcattcttgtgcacacccacagagcactgtgctgcactagccaggatcccttgtgtgtttattcagaagcctgttttctgctcctggttgagaccttgcacagacctgtggcttttgtctttgttctgagggagctgcagttgtgccttctgtttagggcactgcagtctcagctgaccatggagtctcctctcccttggggacccttagtgtgtcccctctgctcccagactcagtgtgtggggacggcgttccttgtcttcccctcctggccgcgctactgcctgtagcttctgcctctagagtagaaagaaccaggaaggtgccggaagctcatgcttgactggagttgcgtgaagatgaccttgtgtgggccccgccagggctttagagtgagccccccaggtgggttcgtcggcagccccatcacctgcccctgagggtccacatgcctgtgccctgccgaggtcatgctttcctccgggccacctcgttctcttcctctgcttcctaaaacaccggacatcttcatcttcttcctgcagaggacgctgggacttctgggcagtcctgtcgctcctgcagacccctactgctgcctcggctcagcccgatcctggccgaggaagccctgtgcatctgtcacctgcgtgatgcggggaggcctctggccgctcccaccttagtgtttaggctttttggtgggaggcagaatgcccctgtggttggccaccagctctgggacagctttggcaccactccccatggggtaaatgaacccatccctgcccatctcaagctacacacgtggctttgctgagtttggggttgggaaggacggtggtggctctcaggagcatgtgagcagctctggccgctgtggtgccttggtgcctacaggtgctccgtgtgtcccctggaggtgctggtcttggttgtagggggagcagccctctcctctcggtgctccatgggtggggcatgggacgcagggatgcagcatgtccctatccagcgaggtctttcccaagaccctgctctgtagctgccatgctactgtggctgctaccctgtatgcagggagagggtcaaatcagcaaaactggtttcttgttttttggtaattttttgttggttttgctttttgctaacttctttcaagatttgtctctcctcccggcttcctatgttggagtatcatatctacattgtcttggtgcctgagttaaaatttccagtgtaatatttgatcgcacatatgaagttgtctttgttatcatgaaattaaggaagctctggtgccaacagtttttttattttgttttgttttgagacggagtctcattgtgtcacctaggctggagtgcagtggtgtgatcttggctcactgcagcctcaaccttttgggttcaagtgatcctcccgacttggcctcctgagttgccggaaccacaggcatgtgccaccacacgtggttattttttaagaatttttttgtagagatggggtcttgctgtgttgcccaggctggtcttgaactcctggcctcaagcagtccgcctgcctcggcctcccaaaatgctgggattacaggtgtgagccactgcacctgaccaacaacttttttttctttttgaggtggagtcttgctctgtcgcccaggctggaatgcagtggcacagtctcagctcactgcaccctccgcctcctgggttcaagcgactctcctgcctcagcctcccgagtagctgggattacaggcacatgccactacgcccagctaatttttttatttttagtagagacaagggttttgccgtgtttgctaggttggtctcgaactcttgacctcaaatgatctgtccacctcggcctcccaatgtgctgggattacaggcatgagccactgcgcctggcccaacaattttttaataatgacatttgagatgtaattgatgcacagattttaagtgtatcatttgagggattttggaaaatgtggataccatgcaccaccatgtctgcatcaaggtactgagcatctccatccctctagaaaattccctcatgcagtccaccctccaccctgccccaggcagctgctgccctgattctctccccataggtcagttgtgccttttctttctttcttttctttcttttctttttttttgagatggagtctcactctgtcttccaggctggagtgcagtggcgcaatcccagctcactgcaagctctacctctctggttcatgccattcttctgcctcagcctcccgagtaactgggactacaggcgcccgccaccacgcctggctaattttttgtatttttagtagagacagggtttcaccatgttagccaggttggtcttgatctcctgacctcatgatctgcctgccttggcctcccaaagtgctaggattacaggcgtgagccaccgcgcctggcacagttatgtcttttctagaacgtcattgaaatgttcagaaacctaccctctacaaaatgacttgaaatgggacatcaaatgtataaagaactttgaaaaaagggattgcccagggaccaaaaaataagagggaactgtaggatgggtgcagtggctcacttgtagtcccaacattttggtgggccaagaagggaggatcacttgagccagaaatttcaagactagcctgggcaacatagtgagaccccgcctttacaaaacatgaaaaagtagaataataataataataaaacacaaaagaatgactgggtgaagttggggtctgcgtgtgccttgcagtaccatagagcagtcaaaacgagcaggagcacagggctctgcattgcagctgaagaagggcgattgacgcatgcagcattgtgctggaaaagcaggttacaaagcacagaatgacgttatgtgtttagtggttaacaacacgcagtggcagcaacacatggcagctgtggtttgtctcctgcctggaatctccggagatgctcttcttagcgtgccacacacctcacctgtgtgaatccttggtcattctatttcagacagcaggaagtcgacgcacagaggtgaagtcactttgtccaaggtcacacagtgggtaaacggttgagcagagcagcctgacttgcacattcaccctcaataaacacacgtactgagataataaaaggagattccaaaaccaggattcaggctggggttacctctgaggggctgggaactagtggtgatggcgttcttctttctttagcaggtggggagtgtgtgggtgttcattgtattggttttttctttattttctgcgtattctttcttacccactgatcaatagcatgtacatattgtttagaaataggaaggcagaacccaggggaaaaatgaagggactttaaactggagtttctgcagagccaagtagggtgtggggacaggtggaggggtagggcatggtgtgttttggtgtgttttagcttattttttattgtggtattctagtttttaatactattttgtctgcatgtgtatttgtagctagttaatgggcacagatagcacctaaagagaaaactgttctgatttcatttattcagagttcgaagacaggttctacggttaggaatgagaatggtggtcgcttttgtgggggaggcagctgggagctgtgtgggtgtggggtgtgggttacacaggtgcagatagctgtcagaactcatagaattgtgcaccagatctgtgcatatcactgtgcatacatgtttgtgcatatcactgtgcgtacatgttatcctagttaagaggtagcataagagatttttgtttttagagacaggaatttgttctgttgcccaggctggagtgcagtggtgcagtcatggcttactgcaactttgacctctcaggctcaagcaatcctcccgcctcagcctcctgaggagctgggtactcgcataccaccatgcttagcaaattttttaattttttgtagagacagggtctcacaatgttgtcttggctggtcttgaactcctgggctcaagcaatccacctagcttgccctcccaaagtgccaggattacaggcgtgagccactgtgcccggcctcataagcaatttttcgatgtatgagtttcctctttgtgttgagggaaaccccagacaggtatagggcaactctggctttagtgcaaaccaggggagaagtggccgggggatggtctgtttgggtcatggttttgtgggagagaggttcccacatctcctgtgattttcagcgtgaacccaagagggtgtttgtgtttgctatttctccaggctttctgggttctcaggcagagttttcgtaagtgctgagggcgtgatgtgggcatttcacacagtatcagcagcttttcctttcaaaggggcactctgccagggtggtgcttttctctaaggtgttgtggaatgtttggactccagagtatctgctgcatgttgctgatgggccttgggaagttcttccccatgctgatgcttgaagcttccaatatgcattctcttttgctcaaacccatgtccggctggcggttggtgaggccactgttcatgggccacagacagcccgtcatcagtgggctccagcctgagcagcctctgcatctgaaactttagtttctgtgctctggagtctctgactgtgcatccttccctgtccatccccagagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaaggtcagttgatagagcagacatttgagcatctcatgggagcaggtctgggggcagtgtttcagcgtaggctgggacagtgcttggcggcctcctgagggcctgtttcagttaattatctgctgctgtgtaacagatcactccaaacttagaggcctgaaagaatgatcagtttacctgtcaccattctgcaggttgagaatttggtcagggctcagcaggggtggctcatctgtatttcatgtggtgttggctggggctgggggatctgactggcctcattggtgcacctgactgaggtccaagctgggatggctccagtggatgggggatggccaggacaatggacctgtctcttcttgtgctgtcagctggcttcatttccatgcctgcaacctcattcctccatggttgctctctttttggacttctttccatggtgactggattcttttcctagggaatggtagaaactatgaggcttgttaagctgggttctcaggactcccagagtgttactttcccccatgtcctgttgctcaaagctaagcataaggccagcttagtctgcaggaactagggtgtagagaagtagaccctactgtcagtgggggagtggcatgtcctgttgtagaacattgtgcacccagggtgtcttgactcatcacaacctttttaacagtctatcataaggacatgggatctgtttaattctctgccatcctgaacatgttacctttttctttcaaatgcttgcctcatggtcacaaggtggcttccatagctccagccatcatgttcaagatgggaagatgtggaaagggtgtgtattagtttttttgttttctgcttatttttttaactgctttgtaacaaattatcaccaacttagtggcttgaaacaatgctcactgagtagctcacagttctgtaagtcagaagtgcaggcgtggcgtgcctgggttctctgttcagggtctcagaagctgaagtcaggtgcctgctgattagttctcttggttcctatttccagcttacccaatttgttggcagaattcagttccttgcaattgtgggtctgtgagcccatgggtccaaggccctatttcttggctggctgtcagccagggagctgctgtcagatcctagaggccacctcattctttgccatgtggccttcatcgtcaggccagtaatgggtaatctcccttgtgtcaagtcactctcagacttcaaatctcttttgccagggaagagacccctcccatttatggcctcacctgattaggtccagcccactcaaggtcatcatcctttcgaggaacttaaagtcaactgatatgagacctcattccatctgcaggcttccttcacagcagcacctagatttagtgtttgggcattcttagaattctgcctccctcattatggatgtttctggctgtctcttctgtttggaaaacaaaaacttttcttgaagttgggagtacaccaacccccatgcctccctgacttggtgggggtcttgcaagaccttgctcagctccaggtagcctggagaatgtgcctatggccttatagccttggcagggggacgtagaggaggaggaggtggacctgggatgggagaagctggcctgggactggccccacagcccataccccacagcctgggtttccacccctttctgaggcaggctggcggtaggatcggtgcatgtgtggggtcatactgccacgtgtgtctcattcctgtctgtctgctgagtgaccttgggtgagttgttgatgttgtatcatccccaaattcacatccacctagaacctcagaatggggcctcatttggaaacagggtctttgcagatgtaattaagtaaagcaccttgtgatgaggtcatggactagggtgggccctgaatccagtgacactgtccttaggcagaccgggagacacacacagaggaggcaaccatgggagatggaggctgactctggagtgatgcggccacaagcccagagactccgggagcccccaggagctgggagaggcagggtgggtcctcccctagagcctcctgagggagcacagccctgctacaccttgatctcagatttctggcctccagaactgtaagaggatgattttctgtcattctgagccacttagcttatggtgagctcttacggcagcccccagaaactcagacagttggcctctctgtgcctcagtttcctcatctgtaacatgggattcatgattgtggcatctggggactgtgcttgtgtagggcactgtgaattatagctgctgggattgggttttgggggataaataggtcaaggaaggagggcagggccagcttggtggtgtagacactggctagccttcaccccagagggccgtggtgcagggtgggaggggacagaggtgtgccaggctgcaggagctcagaggcactagctgccagcagagtgggcaccagggtgtctggaaaggtgtcagtggcagtggctcatccagcctgtttccctgtctgtaaaatgcggatcccaaagtgcacccagctcttagggcaggagaggggattaacatgagatggtgcttggcaggggtgcactaattgctttatcccatcttcctgctgctgtttttatccctagggtgacacacgactcagacactagggggcccaggcttgcacatctgcgggctctgtcacatttgtgctccagggagagaagcagacaatgtctgcagcgtgggccaggggtcctgtgtggccacacagaggaatgctgacgttcagcaagtgcctgggtccatgagggctgctagagcagaacaccatagcctgggtggctcaggaaccacggaagtgtgaagtgtgctgcttgcagctctggaggtcagaagtccaagagcaaggtgccagcagattccgtgtctggtgaggccgcttcctgtttcatagacggtgccttctaactgagtcttcacagtggaaggggtgagggagcttttgaggtctcttttataagggcattgatctcattcatgacccaagtgattcctaaaggctcctcctcctaacaccatgaccttggggataaggatttcaacgtgggaattttgggggccacagacattccaaccatagcagtgagaatgtgggagctaggttttgtgatgctctcagggttttaccccaaaggcaggactggcaggctagcgtgttctctgtgtaagtgcttttgttaaattgacttcttaacatattgtatcacgcctatctgctgttcgtggaatgttgtgtcccctccacagtttatgttgaaacttagtcccctgagcaacagtattaagagggggcctttgggaggtgattaggcgtcgaaggctccaccctcgcgaatggatgagtacccctagattataaaagggcaagttcaccacttccatcctgtctcgcatgtgagacacagcaataatgtgctgtcttggaagcagagagcagccctcaccaggcagctgaacctgctggcaccttttcatttgtttggtttttgagacagggtcctgctctgtcacccagactggagtgcagtggtgtgaccatgactcactgcagcctcgaccgcctgggctcaagcagtcctcccgcctcagcctcctgagtagctggaactacaggcacgtgccaccatacctggctaattttctcaattttttgtttgtagagatggggtcttgctatgttgcccaggctgatctcaaacttctgggctcaagcaatcctcccacctcagcttcccaaagtgctgagattacaggaatgaaccactgtaccggacctgactgattttttagagtacgtaattcaagtaacataaaattcacccttttacagtgtacgatttggtggtttttaggttgcgtaaccacaccacagtctaattccagaacattttcatcaaccctaaaagaaactctatgccccttcatagtcactccccattccccttctcctcagcacttagcaaccactaatgtgctttttgtctccctggatttgcctgttccggacatttcatttaaacagaatcatataatatgtggccttttatgtctgtcttttttttactgggcatgatgttttcaaggctcatgatgttgtaacatgtatcagtacttccttttcatagctgagtcacattccattgtatgaacagatcacattttgtttatctatgcatcagtggacaggcatttgaactgttgccactctggcaactatacataatgctgctataaacgtttgtatgcaggctttgtgtgaatgtatgttgtcagttctcttgagtagatacctaaagagtagggttgccaggtcatacgataatattatttaccttagtgaggaactgtcagactgttttctagagtggctgcaccattttacattcttcaatcagcaatgtatgaaggttccagtttctctacatcctcaccaactcttcttgtttttatttatttatattttatttattctttttttagagacagggtctcactctattgcccaggctggaatgcaacggtgtgatcatggttcactgtagcattgaactcctgggatcaagcaatcctcccatctcagcctcctgaggagctgggactacaggtgtgcaccaccacacccagctaatttttgtatttttagtagagatggggtttcaccatgctggtcttgaactcctcacctcaagtgatccatccacctcagcctcccaaagtgctgggattataggcgtgagctaccatgtctagccatgatgctagaccttttttttagataaatgatttgcaaatattttctttctttttttttgattatgtcttttgctgcatgaaggttttaattttgataaagtttaggctggacatagtgatgtgtgcctgtaatcccacctacttgggaggctgaggtgggaggattgcttgagcccaggagactgaagctgcagtgagctgtgattgcaccactttactccagcctgggcaacagagtgagaccctgtctaaaaaaaaatttttttttaaataaagcttaatttatcctcttttgttgcttgtgtgttaggtgtcatttctaagaaatcattgcccaatccaaggtcacgagatatacacctctgttttcttctaagattttagtaattttagctgttacatttagggctttgatccattttaagttaatttttgaatatgatgtgaaatagtggtccaacttcatcatttgcatgtggaaatgcagctgtcctagcatcatttgttgaagacatttttctccattgaattttcttggcacccttgaccataaatgtaaagggtttatttctggattctcaattctgttccattgatttctaagtttatccttatgttaataccacagtcttaattaccatatctttgtagtaagttttgaaattagaaagtgtgagttttccaactttgtgtgttttcaagattgttttggctattcaaggtctactgcatttccatatgaattttagaatcagcttttcaaattttggaaaaaaggtaggtgggattttgatagggtttgcattgaatgtgtagatcgatttggagagtattgctgtttcttctaatccatgagtatgggatacatttctatttatctgggtcttttaagatttctttcaatggtgttttctaattgtcaacatataaagtttgcagttcctttgtaaatttattgctaagtagttaatactttggatgctactgtccatggaactgttttcataatttcagttttggagtgccattgctaaggtacagaaagagaattgacttttgtatattggtcttttatcctgcaaccttgttgaacttgttgattagctctaatatttcttttgtggattcctgaggattttctgtacacaagatcgtgctatctctgaatagagacagttttacttcccaatgacgtttcttccttttaaagtgtaggcatttacggctgtgcatgtcccctgagcagtgctttcactgcatcccatagtttggtatgttgtgttttcatttccattcatcttaaagtattttctaatttttcttttaatttcttttttaaaagtgtgttgctttatttccacatatttgtgtattttccagttttctttctgttttctagctttattccattatggtcagagaagatactttgcctgaattcaacttttaaaaatgtattgacacttattttgtggcctaatagatggcctatcctggacagtgttccatacacacttgaggaaaatgtgtattcttctcctgttgattggaatattctatacagtctcatgttgactggaatattctatagagtgttctccctgtgggggataggttccaggactcctgtagataccaaaatccatggatcatcaagttctttatatagaatgatgtagtatttgcatataacctacacatatccttccttatattttaaatcatctctagattactcatagtacctaatacaatgtaaatgctatataaatgcttgttatactgtatttctaaaaatttatattacttttattgttgtgtcatcattttttttccagaatatttttgatcctcggttggctgaatctgcacacgtgtaacctgtgaatttggagggctgactgtataaatcagttaggtctagttgatttatagcattgttcaagtcctcttggttttaacagatcttttttctagtcattctattattgaaagtggggtattgaagtctctaatattgtagacattttttctttctttaattctgttgatttttgcttctcatatattgccctctgctttaggttagtatatgtttataactgtgatatcttactgagagattggccctttcacagtgtgtagtgttgtttgtttcctctggcggtttggtttcaggtctgccttgcctggtgtttgggagccattcctgctcttttggctgctatggtttatgaagcatcttcgagccttccacctgtttgcgtctttggctctaaagtgtatgtcttatagataggtgaataatgactttttaattaagaattagttttataattgagctgaaattcatataacatacagttaaccattttgaagtgtatacttcagtggcatttaatgcattctcaatgttgtgcaaccaccacctctgtctaatttcaaaatttttcatcagaaatttttcgccagaacaccccatagtcattgggttattactttacattcttccttccccccaccatctggccaccctgcgttttgctcgttgtctctacagattcgtttgttctggatacttcatgtaatagaaatcatgcaatatgtgtcgcttgtatctggttcttttactttgtgtaaacttttcaagattcctccaagttgtgcgtaacatgttccagtgcttcattactttttatggctgaataatgttccattggatgtgtatatcacagcatatcacagatgctgttaatttttgttgctgtttctgttgcttttgtttgtgtatgtttagtgacttttctgaaccaattctgtaaagtctatgttccttatcatgggtggccactgaagcctctgctcagtgagcttattggccagctgatgattagaacagtgattttaatagatgtctccaacaataagtctgcctgtctttggggcctgtgtgtggaaattggcccatgcattcaacacagctaggcagacgacagctctacctgtgcctttacttctggcctcacagaacctcaaggctagccagctgtgtgagtgttaggccttctcaggcattacctgagtgtgcacacagcctgtgcatatgtgtgaccctctctgtgcccaggagtgtgttgttggagctttccaaagcctcctgtggatgtcttgttctccagcatttccttttaggctagagacttttggttagactattgttcattgcaaccgttctccactgcttcaagcagccattgtgtttgtaattacctctgatattttttcaaaaaatgcttcttgagaaaatgcttttgcactgggtgaactactcaggccaaacaaattcagccctggtgagcgagttttccagggagctaccaaacaggtgaaataatgacagtgctctaggaatggccctctctgcgggttgccagggtgctggtcttcatcctgattgtggactgttggttttcacagttatctcagagctagagtctggtaggtttaagaattgggtgggttaaaacaccacacatctagctattcttactgagatgcagttgtttttcatgggtgaatgctccccagattgctgcaagtctttgattaattttcagacttctgaaaagttgatttcaacattttttttggccagtgcttttctttcttttgtggaggagaggtttttcagaagttattattttgtcatttttgctgacatctctgccaggggtttttgaatattgaaccagccttgcattctttggatgtgtttgggtttgtggtgtgttattcttcttacatactggattcagtcggctgatatgttgctgagtatttttatttttatgttaatggagaattttagtttgtggttttcatatactgtctttgtctggttttgatatcagggtaatgctgtcctcaaaaaaatgggatggaaagcatttcccttctcttctgttttcaagaagatattgtgtagaattgatgttatttctgttacttttaaaacatctttttaagttatttcattgacgaagcaagtaatgccatcttggcctagagatttctttttgtggaatatttaaatcaccaagacaatttatttaatagatgtgggactgtacaagttgtctattttatcttgggtgagtattggtaatttgtggtttctggggaattggtccatttattcaaatggatttaatttatgtgcatggagttgtttgtagtgtttccttattaccatagtgtctgtagggtctgcagggatagccttgtttcattactgatattgttagtttgtcttttctctctctttttttctttgtcttgttagaggtttgtcagttttattgatcttttcaaggaaccagttttaggtttcattgattttctctattttcatcaatgttattgatttctgcttttttctttatttccatccttcatcttgctctgggtttattttgctcttccttacctaatttcttaaggtagactattagtttcctgattgaaatacttcttgctaatataaatatttcatacagcaattttttctctaagcactgctttagctttatcacacacattctgatgtggtattttctttttttttttttttttggagacgaagtctcactcttatcccccaggctggagtgcgatggcatgatctcagctcactgcaacctccgcctcccagattcaagcgattctcctgcctcagcctcccatgtagctgggattacaggcatgcaccaccatatctggctaatttttgtgtttttagtagagacggggtttcaccatgttggccaggctggtcttgaactcctgacctcaggtgatccgcccgcctcagcctcccaaagtgctaggattacaggcatgagccaccacacctggccctgatgtggtattttcattgttgtccagttgaagataatttctaatttcccttgatactgcctcttaaatgtgtagattattcagaagtgggtttaatttccatgtgttcagagattttactgttacctttctgttactgatttgtagtctaattccattttggtcagagaacataactttgaaacatttcaattctcttaaatttgtttcctgaaccagaatatgtcctaggtgggcgaacattctatgtgttctggaaaggagtgttttctgctgttgttgggtggatcctaccagtgtcacttaggtcatgatggctcatggttcagttcatctgtatccttgatgcttttctgtctgccagttttatcagttattgagagaagagtgttgaaatcctcagctatgattgtggatttgtctgtttttactttcagtgctatcgatttttgcagcatgtattttgaagttacattgtgaagatcattttgtcttctttgcaaactgacatctttatccttatgtaatgtccctctttctccctggtaattttctttgttctgaaattttcgttgtttgatattaatatgaacaaacaatccagacttgtattattagtgtttgtattacatgtattttgccattcttgtactttgaacctgcccatataattatattggaggtgagtttcttgtagataacatgtagttggctcactactttccaactgataatctctgtcctactatggatgtatttattctattttcatttatgttgtgattaatatatttggatccaggttgactattttattacatttttctgttttttcccctttttttcggttcttctgtttcaacttttctgcccattttgggttatttagatttttttttttagtatttctttttaatgtatctattgtgattttttttggtcacctatggattgcacttaacatacttaactcttcatcatctacttaagatcagtattttatcacctccactggaatagagaactcctaccatcacataggtctcttttactccctgacctttaaattattatggtagttatcttacgtattatctctacattcactgaaaacctcatcagataatataatttttgttttttaactatgaaatttattttaaagaactcaagaggaggaatataatctgttttatttgcctagatgttcagcatttctgttactcttgcctcattcctgctgttgcaagtttccctgagatatcatttcccttctgtctgaaggacatcctttagcaattcttttagagcagctctgccatcagtgcatcttcttagttttcctttattcagaatgtgtctatttcacctgcattcctgaaagatatttttggaaaattgagaattctgggttgatggttcttttcttttagcacttgaaaaaatgttccacttattctggccttcatgattaaaaaaatatttaattgacaaataaagattgaatatatttaagctgtacaacatcatgattttacacacacacacacacacacacacacacacacacacacagggtgagaaattaacagtcattcaaactgttcccctacaaataatgtgttggtcttctctgcttgctttcaaaatttttttctttgtctttaatttttaactcttttaaaatgatacatgtgggtgtggattttttggggtttattctgtttggggcttgccaaattcatctaatctggtttatgtcttcttccaaatttgggagatttttagtcattatttcttcagattattgtttctgaactatattttatcttctgcttctagggataatgacttcaatgttagatctttcagaatcatcttacaggtccctgaggctctgtttttttgttttgttttaaatccctttctctctgttgtttggattggataatttctattgatctgtcttcaatttcactaactttcttctgttattgatattcaactattgagcctatacagtgaattatttcaattactatcttttcttcttataaactttccactcagtttttctttatatcttctctttctttgctgagactttttaatgttcccattcctttcaagggtatttgcttttacttgttgaagcatttttgtattaactgcttgaaaatcgtcagataattccagcattggtgtcatcttgacggtggtatctgttggtagtcttttcatgtgcatgctacttgattcttcctatgccccgtaatttcagatggtgtcctgggtattttgaagactatgttacatgacttcaggtcttctttacatactaggggaatgttgattttttttttcaagctggaaatcagcctagttgacttctgtgggttgatgtcttcaaagcctgtgtggtttgatctgtcctgcccgtgcacctcctgtggtcgtgtgtatgtgggcagtgctttgtccccgagtacagtgatgtgtgcctctagggggagccctggagttcttgaacaactttgtgttctatttttcgagcatctccctttccaggatcctctccaggactttctgctttcctggagcttgcctttcagttctacagacaaaaaactggagctttgtgtttgctgccctgatcctgcttcttatggttgcaactgtatgtgccagagctgagcgccaggaggacagagaaaaaaaaaatcaacagtgcttacccttgagatcagagccccttccattgaagaggagtgtttccctttttttttttttttttttttgagatggagtctcgctctgtcacccaggctgtagtgcagtggcacaatcttggctcactgcaacctccacctcctgggttcaagtgattctcctgcctcagcctcccaagtatctgggactacaggcacctgctaccacacccgactaatttgtattttttgctttttgatttttttttttttaattgagacagggtctcactctgttgcccaggctggagtgcagtggtgcgatcttggctcactgcaacctctgcctcccaggttcaagtgattctcctgtctcagcctcccgagtagctgggattacaggcatgtgccaccatgcctggctaatttttgtgtttttagtagagacgggattttgccatgttagccaggctgatcaggtgatccatccgcctcagcctcccaaagtgctaggattacaggcgtgagccactgtgcctggccacatatggctaatttttgtatttttagtagaggcggggtttcaccatgtggctaggctggtcttgaactaacctcaaatgatccacccacttcaacctcccaaagtgctgggattactggcatgagccattgtgcctggacagagtgtttcctttatcaggagtttagttgttcacacctgcatggtctggggtgtgagaaagaagaagaaacaggggtgtcttctgtcctctctgagcacttgtgcttccctcttccataccttgagggaggctacaggattcactgggagcccgctctgcacaaatgcccgcctctgggttttgggtgcacaggtcatgggatgaagggtgctgggactttgaatgctgttcctctgccgcccccatccacctgctgctctcctttctgagtgttcagatagcagctccttggtctcacaggtgagatgtggggtgtgcacctccaagagtggagccaccagtaggtgcttttgaaaactgcaagttttattataaatatgcaaatgaacccagaccttggcatttcttgcgtgagacaagtctaagcatccttgcgagggtatttgtatctcattcaggcgaatgtcgcaggtaaaccaccaggtaggtagctggggacctgattcagtggcttagctgcactgaggggccaccgagactgctgcatgcctcctccctagtgcagctgcaggcaggcagtcacctgtgcactcacacacacatgcatgcatacagtgcacttacacacacatactctcacacacgcctacacatacatgtgcacacacatgctcacaatgcactcatatgcacacacacattctaacatgcacacctacacacacatgcactcacacgtatgaatgtacacacatgcacacgtgcactcacatgcacctacacacacttgcacaacatacacatgcactcacacatacaccacccacacatgaacacacacacatataaactcacacacacacacttgcacatacatgcatacatatcccaacaacacatttacatatgcataaatacatttaaatacacacaaacaacacacaagacatatatacacacacatacatagacacacacaaacctaaacataatacacacacaatacctacatatgcactcacctacatatatacacgcacagacacctcactcccacatacacctatatacacatatacccccatacacacttataccatatacatacattcaaacacatgtacacttgcacacatacatatacacatttaaacacatatacacaaacgtacacacatgtgcatacacatgcttcatctcatacacacaaatacatgcatgatacacatacacatgaaaacacacttaaacatacacacttgctcatacatattacatacacatattaaaacacattcccattctcaaacacatccacatgcagtgtgattgtgagtgattttgtgaagtgcatatcaaagagacacagtttccctgaaagtactttgtgagtccttctctaaagcaaacataacaaatgtcaaagagcttggggaagccctcccttggtgatcaggcagattcgagggccatggaatgagcagcagatgtagctgcccagctggttgagtatgctgcggctgtgtgactggatttgcatctgtgctcatgcttagaggtgctcatgcgggatgctggtctgccacatgcccagtgctagcaccgctgctgaagacacgttgctgacaggctgctgtgtgggtccttgcaagatcctcgcagtgcctgaatccatacccgggtccctgagaacatctggctgcagaggttcggctctgggactcctcagcatgctcagtgaggcggtaacacttagtcaacttggtttaaaaacacagcagctcttttagtgatcgttttgaagacaggtgtggacttggaggtgcatttgaaagctggtgtccactcacttgggctgtcctgtacacctccggagtggactttggtccttaattcctggggatgaaaacatagaagtttcacagttagactttgactgcaccatggagactagattaggatgggggggatcagaggcgggaggctctgccctgcctggtccagggaggggagggccgggcctacagagggacagtggtcccgtgggtggaggagagggctgggtctgcagagggcccgaggtcccgagggtggagaggaggccataggctcaagagccatttaagaggtggagcacaggctggggcgcggtggcccgaagtgtagtcccagcacttcgggaggccgaggcgggcggatcgcgaggtcaggagattgagaccatcctggctaacacggtgaaaccctgtctctactaaaaatacaaaaagttagccaggcatggtggtgggcacctgtagtcccagctacttgggaggctgaggcaggagaatggcatgaacccaggaggcggagcttgcagtgagccaagattgcgccactgcactccagcctgggcaacagagcaagactccgtctcaaaaaaaaaaaaaagaaaaaaaaaaccagaggtggagcacaacagagtggtggccaggtgggttcagggttgagaacagaggagatgggaggtgaactgcaagcttgggcagatgcgtagatgcaggggctgtatctgagatggggcagtaggcaaggagtaggtgtgcggggagaaatgggtgaggagctgttccgtcctgtccaacctggggctggagttgccacaaaggcagtggcaaggagttcccacaagggagtgccccaaaccgtcccacagtgggatgcttaggattccacagaaagaagcaccaaaccccagggcgatcagtccagagctttattagaggaacttgcttacagaggaggactgcagcatattcttgtaacagacagcaagaaggcagatgtcccacccaggcatgtctgccatgaggggtcagggtatggagtttatctcagggatgaggactctggctcagggccaagcagggtggctttctctgtatttagcaagatggcggatttctcagagtcttgagcaacagcctaaacacctttatccatgcctggttcaagcctggaggggaaaacttgcaggtgggtcaggacagataaagaaagtgctggggatgttgggggttgctatattagcctatgtgggacatccaggagggagtagctctctgggctggacctcggtcgatgctgagctgacaagggagctttgggatttgttggcatgtcaacggcaggagagggtgggcgtgcaccaggacaccatgggcaagggaccgtgataacaaggctcgccctggggcaacactgaggaggctgagaccaccaaggaagaggcccaaaggagcaggaagagaatctagagagtcgtattttggggtcagtgaagactttgatgcataagtgacgtgcaggtgtgaatgccatggtgaagcaggagcggctggggaagggctgaaggaccgcagccccagtgggcacaggtgaccttagcaggagcaagggctccatggctgctaagcagatctgagatgaggatgtggacacagctggtgtctacagctgtttccccaaccaggctttgaagggcaagagagagagcaggggtaagatgcagggctggttctggcctctgtggcctccggttactgctgtgacatgagggggtgtcagagcctcaccacctgctgctgtccatctgccagccctagcagagccaccaggtcaccaaggatgagctagtgaaaggcaggcagctggatgcatcattatttcctttgtaaaaattaatttacaacataaaaacaccatcttttgtatgttgggcacaaatatgtttttaaaaagatttttaaaaaatctaagtgtccaacagcagatgaatggatgaagaatatgtgttgtatattatggtatgcagggggatgctattcagctgccactcaactacatgggtgaagctggaggatgttatgttaagtgaaataaaacataaagacagttactgcacagtctcacttatatgtggaatccaaaaatgttgaactcgtagaagtggagagtaaagtaccggaggcttgagggggagctaggtcatggagatgttggtcaaagtgtacaaagtttcagtttggaggaataagttcaagagatctattgtacaacatggtgactgtagttaataacaatgtattgtattcttgaaaattgctaagagagtggatttttagtgttctcaccataaaacgatacatatatgaggtaatgcatatgttaactagcacaatttagcaattccacagtatatacatatttcaaaacacattgttcataataaatgtatacgtttttagtaaatttaaaaaaggacttttaggataaactacagagagtgaggaagaagcaaaaataataaaagaggccatgcagaaaaatttcagaaatgataaacaacatgaatcctaaatttatagactcacaaggaatcattgtaagtgtaaagaagataaattctcggctagacatatcatagtgaattgtagaaggccaaaaaccaagaggagagccttaaaactaccagacagaagaatatattaacagaacaacagttacctttcctatagatttttcagcagcaatgaggagcccagaaatgaaataatggcataatgtccaaattagcaagggaaaacagctgtcaacctagaattctatacccagctaagctatcattcaaaagtgagtgtgaaataaagacattttcaggaagtagattgacagagtttaccattcacaaaaccttcctgagagaattaccaatagatacacttcataagaggaaaatgtcatctaaagtaacataataggtgctgaaagtagtgatatgaggaaaccaaaataatgaaaagatccaatcccaaggcctaggattagattataccaatggcaattggccctctagaagttgtaggctgcattagcagtcctttgtgagtcagtgctactgcccattttgccagtgttacttaaggaattatgtctgaaaatacctatgcattggtgtgcaggtcacaaactgtccttctctttgtttgtatacttaggagatcacagctggtaaataaatgccagagcctgaattgcagcatataccagtctgaaaattatctaactgggaggcttcagattctgagaactaacctattgcctgccctgtgcatcttcaaaacgtaaagttctttttgttgagaaatccaggaacagggcaggcttgtggctgaaccatcagagttttgagatcaagaaggtgggccctcattcagttctagtaattggaatatgtctgaccctgtgtgtcccactctgtccccagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacagatgccggggactacagctgcgaggccaggggccagagggtctccttccgcctgcacatcacaggtgggtttcttgagatctttcttatgttccttaggataatttttagtgacattagcgtggaggtgccacctaattgcctcttttcttacaaagcttcccctaaaataacaactagcaggtattaattttgtgccaaggggcatagattttgtgaatgctacttgtctttcggcttgcttaaacttcaaaacaatcctatgaggaggaactctgattattcccattttaagataacacacaaggaagtaatttaccacagttcacaaagccagaaaattgcagtcaagatttggacccagtattctgggattattattcctttttttcttcttgaagagtattatcttcagtatttatgtaagctgctctgctggttatatatattctcatttttttctcatatgaaaacatatttgttttccctttgattctgagggctgttttatgtgggtataacgttacagtttagcagctacccctccacccccataatattttaaagaggtcattccattgtcttctggcgtccatatttcctttgaaatatcaactgtaagatttattttggatattttaagggtcatgtatcttttttcatcctgttgcttttaagattttctttttgaatttgcttcatggcatttttttctttgatgaacctaggtgtggtttcctttgtcttcatccgtgttgggattgtagagcatcttgagtctgtgggtttatgtctctcatcagctgtttgctgttactgaatcccgaatcttcagcgcctgtgaaatgggttggtcccagatttgtgtctctgactgtgcgtctctccttgtccaccctcagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacaggtgagttttttgaggcctttcttgtgcttttaggatagtttttagggactttgggtacatatggaggtctcacccaaggacctttttttctcatagagcttcccctgtaataacaactagcaggtattaattttgtgctgaaggcctagattttgtgaaatgcttcttgtctttctgcttgcttaaaattcaaaactattctgtgaggagtaactttgattattcccattttaagataacacacaaggaagtaacttaccacagttcacaaagtcagaaagttgtagtcagaatttggacccagtattctgggattattattatttttttcttcttgaagaattctgtcttcagtatttatgttagcagctctgctggttatacatattctatctttttttctcatacgaaaatatatttgttctccctttgattctgaggactgttttatctgggtataacattacagtttatcagctattcctccactccctaacattttaaagaggtcattccattgtcttctggcgtccatatttcctttgaaatatcaactgtaagatttattgtggacattttaagggtcatgtatcttttttcatcctgttgcttttaagattttctttttgaatttgtttcatggcatttttttctttgatgaacctaggtgtggtttcctttgtcttcatccgtgttgggattgtagagcatcttgagtctgtggatttatgtctttcatcagctgtttgctattactgaatcctgaagcttcagtgcctgtgaaatgggttggtcccagatctgtgtctctgactgtgcatccttccttgtccaccctcagagcccaagggggtgtttgcgaaggagcagtcagtgcataatgaggtgcaggctgaggcggggaccactgccatgctgagctgtgaggtggcccagccccagacagaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacaggtgagttttttgaggcctttcttatgctattaggataatctttacagacttagggtgtgtatggaagtcccgcccaagggccttttttctcataaagcttctcctgtaataacaactaacaggtattaattttgtgctgaggacctagattttgtgaagcgcttctagtctttctgcttgcttaaacttcaaaacaatttgcgaggaggaactctgattattctcattttaagataacacacagggaagtaactcaccacagttcacaaagccagaaaattgcagtcagaatttggacccagtattctgggattactattcttttttcttcttgtagaactatgtcttcagtatttatgttagcaggtcagctggtcatatgcattctcttactttttatttctcttgtgaacacatatttgttccccctttgattctgagggctgttttatctgggtataacattacagtttagcagctactccccactccctaacattttaaagaggtcattccattatcttctggtgttcatattttctttgaaatatgaactgtgaaatttgttatggatattttgagggtcatgtaccttttttcatcctgttgcttttaagattttcttcttgattttgctttgtggtagtatttctttgatgaatgtaggtgtggtttcctttgtcttcatcctggttgggattgtagaacatcttgagtctgtgggtttatgtctttcatcagttgtttgttgttactgaatcctgaatctttggtgcctgtgaaatgggttggtcccagatttgtgtctctgactgcgcatccctcctgtccaccctcagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggctgcgggctgcatgcggcagctggtggtgcagcaggcaggccaggcagatgctggggagtacacctgtgaggctgggggccagcggctctccttccacctggatgtttcaggtcagtgctttgggggtactaactttgtagaggtgatgatgagactggctgatagactctggtgctcttcccattagcctttacctctgttgtttccaaccctcccaattcttatttcataactggtgtggttaagggaggccaaatgggaaggatatgtgtggagggagaggggctgttgctgtgtacctggagtggtgttttcatgtgataatgctcaatcatacgttcccatcatctgcctagaaccttgctgctgttccttctctaccaggcccctgtggtccaaggtagaccaggtgtctccacctggggttgtgtgaatttccttctactgaatgtctggcagctctcacatgcctgcaccccatacctcatgcttgttctccctagtgacagatgtttgaatttaacttatctgggagaaggggaaatttcagccacacaaccgtacatagaattatctcaagatcacactgtggattatctgattttctatgtcctgggaccttctcccctcctttttatggacatggaagctgcctgtgcacccacaggtagcaaaacctagatccatgtttgttgcaatgtctgtgtcaagtaaaacagcagcatggattggtacatatgagcctgtgatatgcacccatgaggtctggaattctcttccaagaacaactcttgttttccattgtttttagttagaacatgtcagattctccttggagcttgatttttaaatttagaaatggaaaggaataagtagcttaggtgacattaccaggtgctgatacaactgagatgcaatagtagcagtatattagtctgttctcacactgctaatgaagacatacccaagagtaggtaatttataaaggaaagaggttgaattgactcacagttccccatggctgggaaggcctcaggaaacttgcaaggccttaggaaacttacaatcatggcggaaggcacctcttcacagggctgcaggagaaagaatgagtgctgagtaaagaagcgagctccttataaaaccatcagatcttggtggtagtagtcactcactattacaagaacagcatgagggaaactgcccccatgattcaattatccccacctggtcccaccattgacacctggtgattattactattcaaggtgagatttgggtggggacactgaggcaaaccatatcaggcagcccctgactggcaaaagcagtatttattcagtagcatttcccagtaattatgttgtgcctgtggcttttcctgactgggtcatagagaattctgaaactacatttattttcttttcattaagagaatcttaacatcagagatctgtgggctgcagcctcatgttgacgcctgggggccaacacataacagtctgttattaccaccgtgcagtggtttgtgggtgggtatagatgccagtaaacccactatatatctttctaaaatgctattttaggagagtatgacaaatatttactggtattaaatatgaacaggttcaacaaattgttaaattgcttaaaaagtatataaaaagtaacataaaaagaaatacacaactcagatagtcctataacttttaaataaatgggactagtaacaaaaatattttcagtaagaaatttctaagcaatatctaacaactttacagtaaattataccaaacaatctgcaaataaattattccatgttcatggagattcttctagagaatacaatgaagagagacactctctgatttgtttcatgtagatagcataacattgatacaaagtaggaagaattaaaaatataggccaacctattatggatagcaaggacaaaatcttaaacaacatattattcatatatatttagcaatatactaagagaatagtatgctatgaagaaagtcgtattacccaggcatggtggtgtgcacctgtaagtccctgctacttgggaggctgaggcaggaggatatttgagccccaggagttggaggctgcagttagctataatcacgtcactgcattcctgcctagggcaacagagcaagatcccatctctcaagaaattgaaaaacaattagctggctgtggtggcatgtacctgtagtcccagctacttgggaagctgaggtgggaggatggcttgaactcaggagactgaagctgcagttagctatgatggcatcactgcactccactctgggtgacagagtgataccctgtctcagaaaaaaaaaaagaagaagaaaaacagattttgggcaattaaaccatatgggaaaaaaaatcagaccaggatctcaaccacacacaaagtcaactccagttggttagagatgtcagaatcccggggaaacccatacaagccttagaggaaaagagagatgtttctagtgacttcacagtaaagcatgacttcctaaacagaacacacatgccctgaccacaaagaaacacatttgatatatttgaatacattaaaattaaaaattttgattctttggaagacaccataagagaatgaaaaggcaagctacacagaaaaggaagatatttctaacatgctaacgctctagtatgctagagctcactgctgtagtatttagatgtaaaaagagatcctaaaatgaaggtgtaaaagaaagacagtgctattgaaagtcagacaaagcacttgcacagtgacaccatagaagagtgaggactccgtccccagaccatcagaaggcgcccagctgacagtcctcctgacatggccccaggaagacatgggaggcccaggccctcctccaagaggccagagctgaccctcctgactggcaggagcaggagcttcagactctggggccctggggtgaggacgcaccctgcacagtcccatggggagaccccggcacatctatgaggggagctgtgcaggcgtcaggactccagtccctgccctggaggatctgtcatggtggccctgcctgggacagcccatggcaccatgcagaatggatggaaaaactatgtttcttgtgctgggaggcagtggtgcagcctggagagcatctgtccctcccacttcccctcccaggccttgtcttcccagtgctgccttcctgacctagatggtggtggtaaccctgtgcatccctgccttccccagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcaggtcagtgctttgtgggcaccgaggagcctcttcggaggtgatggtggttctggctcgtagcaccagcatatctctgtgcactttccttccaccttcatgtctcgggcttcccatcctcctgctcccatttccatccctgtggctgggccaagggaggggtgtgcatgggagggagaggggctattcctgcaaacctggaggtgtgtttgcactttgtaatgctcagtcactcattcctagcacctgcccagagccttcctggtgctccttggcttctgggactctggatctcccttgtcttgggttctgaggttgaccaggcatctctttcctggggctctgtgaatatcctgtcagtatatgttctggaagctaccatatgccctcacccagcagcacatgctagttctggtcagcgagagatattttgatttttttcctggtggagtgacccaaaccttcattcctgaagggtctaggtcatttgtagtcctgcctggattgggttgtcgtagtttcccattgaccttaatcgcagggcatgataatactgagagatgtcctaagagattgcctgtattccacgcatatgcctccttacctccattgtgaagtagtagactgatttcatcttgatagttcgggtcagtcaccccaaccaacaatgtaactcccttagcctgttgacttaaaggtaggaggagcccaaagtggccaggtggcaatcttaacttccagtttaatgggatcgttgttgtgtctcctggtggcagcattcctccttcaggaactaagacctctaagccggcagaacgtaatgtcatgggaacaggaagcaaaaattttgctagtgggtcactaggggtgatggtgagtggtgccacttccacttccatcccttgattcctggattcgtgaatcctggctatgggaaaaacagtgccatatattggacaccgattcagagcacagacagcctctggagaactttgccccagccctgcaaagtattgacacctagttggcattggaattgtgacttcaaaaagctattgcactgttctatcaatccacttgcttcaggatgatggggaacatggtaagaccagtgaattccatgagcataagcccactgccacacttttttaaccatagagtgctttggtcagaggcagtgctgtgtgaaataccatgacggtggataagacattctgtgaatccatggatggtagtcttggtcaaagtgttgtgtgcaggatagacaaacccatatctggataagtgtctattctggtgaggacaaaccattgccctttctatgatggaagaggtccaatataatcaacctgccatcaagtagatgtctgatcaccctgagaaatggtgccatatcgagggctcattgttggtctctgctgctggcaaattgggcactcagcagtggccttagtcaggactgccttggtgagtggaagtccatgctgctgagcacatgtgtaacctccatccctgccaccatggctgctttgttcatggacccattgggtgatgacaggggtggctggggaaggaggctgagtggtgtccacagtcatcctattcacttgattattaaaatcctcctctgctgaggtcaccctttggtgagcactcgcatgagatacaaatatcttcacaatttttgaccactcagagaggtccatccacacacctcttcctcaattttccaatcatgcttcttccaagtccctgaccatccagccaaaccattgtctacagcccatgaatcagtgtataatcgctcatctggccatttctccttcaagcaaagtgcacaacgaggtgcactgcttgaagttctgcccactgggaagatttccatttgcccctgttcttcagggatgtcctagaaaggggctgtagtgctgcagctctccgcttttgggtagtgcccgcatatcgtacagaaccgtctgtgaaccaggccctagtcttctcttcctctgtcagttgatcatagggaactctccatgaggccattggtgcaggctggaggagagaaggcagggtggcaggagtggggaccatgggcatttgagccacttcctcatgtaacttacttgggccttcaggacctacttgagcccgatcatgtatataccacttccatttgatgatagaatgctgttgtgcatgcccaactttatggctaggtgggtcagaaagcacccaggttatgacaagcagttcaagtcacatggtgacttgatgatccatagtcaattgttcagtttccaccaaagctcagtaacaggccaagagctgtctctcaaaatgagagtagttatctgcagaagatgacagggtgttgttccaaaatcctaaaggcctccactctgattcacccgtgggggctgccaaaggctccagacagcatccctatctgccactggcaccttaagcaccactggatctgctgagtcatatggcccaagtggcagagcagcttgcacagcagcctggacctgttgcagacccttctcctgttctggaccccactcaaaactggcagccttttgggtcacttgataaatgatccagagtaacacacccacatgaggaatgtgttgcctccaaaatccaaatagacattgtgcctctttcttggttgtaggaggggccaaatgcagcaacttatccttcaccttagaaggaatatcttgacaggccccacaccactcgacccctagacattttactgaggtgggaggtccctgaattttagtcagatttatttcccatcctctggaatgcaaatgtctcaccagcaagtccagtgtgtttgctgctgtgtatatctgtgttcccttggctgatacatagggaagcctgagaaatacaattaatttcctttttttttttttttttaaaataaagagagtgttgatgccaaataggggtgggctgaagtcccatggtgacctctgggtgctaacacataagtttggtattacatcagcatcagtgttatgtggatgtgtatagataacagaaatcccactgtatatttctgtgaagttattttcagagaatatgacaaaatgttttatgtaataaatttgaaaagttgtgacaatttggctaattcctagtaaattacatgaaaactcacataaaaggttacagaaaacttagtcctataagttttaaatagatggaggcagtagtaaaaaaatcttttaaacccaataattttctagtaaactgtttcaaatattctggaaagcagttactccatattcatgaatattgttctggagaatagaaaaaggagattgactccatatgccattttatggttttttttttttgtttgtttgtttgtttgagacagggcctcactctattgtccaggctggagtacagtggcatgatcttggctcactgcaccctctgcctcccaggttcaagtgattttcctacctcagccccccaagtagctgggattacagggatgcaccaccaccacaaaaatagcatgtgtgccagctatttttttgtatttttttttttcagtagagacggggttttgccatgttgcccaggctagtctcaaacttctgggctcaagctatccacccgccttggcctcccacagtgctggtattacaggcatgagccaccatgcccaggccatcattttatgtagatagcgtaacattaataccaaaatctgacaaaggaagtaggaagaattaaattgtcgaccaatctatatggatttgtcattatggatatcaagaacacaatcataaacaaagtattagcaaatggaattcagcaatgtatcaagaagacagtgcactctgttgaagatcctggtcccagaatgcaaggctggtttggctttagaagcattagatcagtataataagcttgaccttaacagattgaatgaaaaatgatgtaattatctcaataaatgcagattaaaagtatttgataaaatctagaagatatatttgagaaaatttagcatcaactcatttcataggattcttaacaaactttatagaagtgttcttccttaatttgataaatggtactagagaagcaccactaggatcccactcagagcaaaccttgaaaggtttggttcagagaaggagacagggcagtgtcaccacttgtatccaacattgtacataagggtaaggaggaaaataacgcaaaaggcatggcacttggaaaaagtaaaagtgaaatttactgatgatatggccatccacttggaaaatccaatagagaacttagtagactaagtaacattgagaatgattattctgttaaaaaaaaaaatcaacacacagacaatacttctgtatctatatacagcagtaaacagttgcaaaatgaaatttgaaaagacttacagtagcatcaaaattacagtgtttctaattcaaagtctaataaagatgtttaaagcctggggaggggctaggaaattgttgtatattttgcaagacaattaagagatctaattaaatggatagaaattcatgaaacattaaaatatattcattaacaatcaggatccaaacaatttttttttgtgggggaatgaaaagaaaatcaaagtatgaacattactctaccagatgtcaaaaattatcataaagttacagtaattaagacaatggatttcaatgaatggttagatatcagaacaaagaaatggaatagtgagctcaggaacagttctatgcatcagtgatctctggatgtcccccttccttttttttttttttttttttttttaaccatggcatctgtgcaagaagtagagaaaggatagtgttttcttttttttttgttttgagatggagtctagctctgttgtccaggctggagtgcagtggcgccatcttggctcactgcaagctctgcctcccgggttcatgccattctcctgcctcagcctcccgagtagctgggacttcaggtgcccgccaccacacccggctaatttttttgtatttttagtagagacggggtttcactgtgttagccaggatggtcttgatctcttgatctcctgacctcgtgatccgcccgcctcagcctcccaaagtgctgggattacaggcatgagccactgtgcccagccaaggatagtgttttcataactagtgtgtggaccattttaaacatatgggaagaattaaagcatattggtaattcatagcatgcgcgagagtcagctcctggtgggttagagacctcagggtaaaaggtaaaacaataaaccccaagatggtaagcataggctatctacagaatttagggtaaggaagtgtttaaatagaacacaaatgccctaaccacaatggacaagattgatatatttgagtacattaaaactaaaaggtctgattcatcagaaggtgccataagagatgaaaacccaagtcacacaggtagggaagatacaaagtgcataattgtgacctctctaacattaaaatatatgaagaagaccttaaagccagggtccccaacccccaggctgtggaccagtactgttctgtggcctgttaggaactgggccgcacagcaggaggtgagtggcaggtgagcattcccgcctgagctctgcctcctgtcagatcagcagcagcattagattctcataggagcatgaaccctattgtgaactgtgcattggaggaatctaggttgtgctccttatgagaatctaatgcctgatgatctgaggtggaacagtttcatcctgaaactatcccaccaacccccatctgtggaaaaattgccttccatgaagctagtccctgctgccaaaaatgttggggactgccttcttaaactgaataaagacaacaagacagtgctattgataatgggacggaattgagtagtgacaccacagaggagcaaacaggaatggccaatcctctagaaagatgctcagccctgtgagccatcaaacaatgaagaaagccacagcgacacaccccgctgaggccaaagctgaccgtcctgacagtggcagaagcgggagcctcaagactggggttctgtggtgaggatgcgtcttgcacagccgcattgggagacccttgctccattcatgaggggaagggtgcaggcgtcaggaccccaatccctgccccagatgagcttgtgtgggcaagatctgtcagccaccccaccaaagacagcctgtggcaccatgcagaatggatggagaaacttccttgtgctgggaggtggtggtgcagcctggagagcgtctgtcccttgcgcctccccttccaggccttctctccccagttctgccttcctgacctagatgttggtggtcaccgtgtgcatcttgccttccccagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggtcgccggggagtacagctgcgaggcggggagccagcggctctccttccacctgcacgtggcaggtcagtgctttgggggttggagagtgactttgtgtggaggtgatgatgagactggctgatggactccacggcctccagtgccctttccatgagactccacctctccacttctccatgccctcacttcccggtttcatacccttggctgcgccaggcttggccggatgggaaggtgcagggaggccaggccctgtggtgcacctggagcagtgctcccatgcagtgcagcctcatcacactgagcccctactccaaacccccatgctctttggtgtccaggcccctggcgctgtctggacctgtggtctgaggtggaccaggtgcctcccctgggaaagtggggatgtcctttctgtcattcagtacctgcctcccttccgcaccacgtggggcttctagcccatgagagacgtttcaaattcatatgacccacataaggggaaattctgcccatgcagtcccacttggaattctttccagactgaacttcggggcatcaaagcttttggtgtcccggcagcctctttccttttttttattttatttattttatggatctagaagctttagaagctcactgtgcacccatatgtggcaaaatctcggtccttgttttcttgcagtgtctgtgcaaaaaatcccagcccagagggctggtgactgtgcccctgggatacaactgcaagattccaagtgcttttctttttttctttttctttttttttttgagacggagtctcgctcggtcgcccaggctggagtgcagtggcgccatctcggctcactgcaagctccgcctcctgggttcacgccattctccagcctcagcctcctgagtagctgggactacaggcacccgccaccacatcaggctaatttttgtatttttaatagagacgggtttcactgtggtctcgatctcctgacttcatgatctgcctgccttggcctcccaaagtgctgggattacaggcatgagcctctgttcccggcctcttcttaaggctattctggctttccttttgtctccagttaacaactttctgagtcagaattcccccttggagtctgatttatgaatttagcagtggaaaggaagaaagagcttaagctatctcagcacacctaatatatgtatatattttgttaagagagtctgggcacagtggctcatgcctgttgtagtcccagcactttgggaggtcgaggcaggaggattgcttgatcccagcagtttgagaccagattaggcactatagcgagacctcgtctctacaaaaactacagaaattagctggatgaagtggcacacgcctgtagtcccagctactcaggaggctgaggcaggaggatcacttgggcccaggagttccaggctgcagtgagccatgatcacaccactgcactccagcctgggcaacagagtgagaccctgtttctggaaaaaaaaataaaagcaacaacaacaacaacaacaaaacaggctaaatgtcagagagaaaaaggttgtggtactacattgactcccaaatgccaacccatgacagcttggcattctatcagtatataatcatttgtagttgtgtatatatagataccaaaaaatcccactgtgtatctttctaaaatattgtgttaagagagtgcgataaattctttaatggtaatacattttataagttttggagaattgccaatttgttagagaaaactatgaaaaagttacacaggaagaaacagacaactcagatagtcctatagcttttaattaagtggaaccagtaataaacaatatttttataaaaggtctaagcccagtggatctactgataaattataccaaatattctcaaaacaaattattgaatgttcttagagatcctttcagagaatagaatgagaagatacactcttgaacctgttttatgtggatagcataacatagataccaattatgacaacagtataaagatttgaaattacaggccagtcattatggatatccaggccaatgcttcaacaatatattttcaaagtggtatgaccagtatgtcaaaaggaaaatgcactatgataaaaggcataatttagaaatgctatactcaatatattcaatattcaaaacatcagaaaatgtcatgcatgacattaacagattgaaagagaaaatctcaataaatgcagaagaaaagtttgatgaaatttaacatcataaattctgaacagctgtttgataaagtttagcatcaggcctggcacggtgcctcatacctgtaatcccagcactttgagaggctgaggcagaaggattgcttgagctcaggcattcgagaccagcctcccaagcagcagggaccacaggaacatgccaccattctgcagggtgccctggggatgtgacagatcctgcatgcagaatggatggagaaactgtgttccttgtactgggaggcggtggtgcagagcctggagagcatctgtccctcgcacttccccttccaggccttctctccccagtgctgccttcctgacctagatggtggtggccaccctgtgcatccctgccttccccagagcccaaggcggtgtttgctaaggagcagccagcacacagggaggtgcaggctgaagcaggggctagcgccacactgagctgtgaggtggcccaggcccagacagaggtgacttggtacaaggacgggaagaagctgagctccagcttgaaagtgcatgtggaggctgcaggctgtacacggaggctggtggtgcagcaggcaggccaggcagacaccggagagtatagctgtgaggctgggggccagcagctctccttccgcctgcaagtggcaggtcagtggtttggggatgctgagttaccttgtgtgtaggtgttgatgagattggctgatagaccccagtactctttccattagagttcatctctggaagtctctcgtaatcctacctgccattttcctacccatggctggcccgaggttggccagaagggataaatgcatacaggagacactgtgagttgtgtttccaggcagtaatgctgttcacatattcccagcacccagtcagaacccacaggtgctcccaggtgtccagccctttggctcaattgaactgaggggctgctactggaggctgaagtagaccagatgtctctcacctgaggccatccgagagcttgcacccagcctcaccagcccgacctgagggctccccctgtggagagatggttgaattccattgaacaaggataagggcaaatttcagccacacaatcattcttggaattatctcatgattgaactttggattatccaagttttaggtgttcggggaccctcttctcatctttcttatgggcataaaaagtctctgtgcacccacatgtggcaaaatctatatcctgggtttttttattttgttgttgttgttgtttttgagacagagtctgtcacctaggctggagtacagtggcacgatctcagctcactgaaacctctgcctcctgggttcaagcaattctcctgcctgagcctcccaagtagccaagattacaggcgcctgccaccacacctggctaatttttgtattttcagtggagatggggtttcaccatgctagtcaggctggtctcaaacttctggcttcaagtgatccacccgccttggcctcccaaagtgttgggattacaggtgtgagccactgcacctggcttgtttttattacactgcctacagaataaatgcagaactgggaattggtggctctggactgcgatacaccactgtgaggtttggaattatcttctgaaagtatatgttgttttcatttgctcttatgtcagaacattctgtgactgaacttcccttagtttaattttgtatatttaaaactgaagaggaataaacaaatcaagctacatcagcacacattttaaagatgaattactatacagcagccactgacagataaagcagtatgtgtttcataccgttctaataattcatggctagttgatagagaaatctgagaacgagttctattttcctttagtaagagagtcttttgtcggatggaggtggagtgcagtcacacacttgttcataggtaccgacacttaacattggtgtcacatcagcatgtaggagttcttgggggtgtacagatgccagaaaccccactttgtaggtacttgaaatgttgttatttgagaacatgccattattattatcattattttgagacggagtctcactctgtcacccaggctggagtgcagtggtgcgatcttcgatcttgtctcactgcaacctcctcatcctgggttcgagcgattctcccacctcagcctcccgagtagctgggactacaggcgcgcgccaccatacctggctaatttttttgtatttttagtagaaacaaggcttcattatgttgaccgggctggtcttgagctcctgacctcaggtgatccacccacctcagcctcccaaagtgctctgattacaggtgtgagccaccatgcctaaccctatatttatgcaagtaaatttgaaaagttttggcaaattgatcaatttcttcaaaactatatcaaaagtagaaataggcaagttgaacagtcctataaccttttatagaaatgcaacaaataatcatcttatagaaggttaccccagtgctctactgtaaactgtaccaaatattctggaaagaaattattctgtgttcatagacattcctctagagtattgaaaaaggacctcagtgctctatctcattttatgtaggtaataaatatcattaataccaagctctgacagggtgaatatgaagaattaaaattggtcaatctcttatcaatatcaaggctcactatcttaaactaaatatagcaccctgaattcagcaatttatcaagaggataacacacaatgacaaaagtcatagtccagtaatgcaaggatggtttaacatgagaaacattagaaaatcagtacaaaatgtgacattaacagattgaaagaaaaacgaatgtgattactccaatatggagactaaaagcattggataaaatacaacatcataaatatgccaaaaatatttggaaaaatttagcatcaattcatgtcatacaattcttaacaaactctaaataaaaacatttttccttaatttcataagcaatagtataaagaaaacaagctaacattacacaaacatgaaaccttgaaagcgttgcctttgagattggaaacagaacaaggacaccatccatcaccacttcttccaacattgtatagcagacagaggaggaaaagaaagtacaaggtggaaaacttggaaaataaaacatgcacctcacagatgatatggttattaatttagaaagccccaaaaaagtaattattagtaagagatttgggaatggttaccacataaaagaatcaatatacagaaaacatttctagatctatgtaccagaaacaagcagatggaaaataatgttttaagagatttccagtaccatccaaaatcttgtagttaccaactgcaagcctaacaaaagacctttagatggtttgtggggggaaattattaaacattgttgagagacagtaaaaaatatctcaataaatggttagaaagctgtaggagacctgaaagtgtaaatcccagtcaaccatagttctgttgggtaagagaatgctgacaagcgcatagcaaaggccaagctgcccttgaggaatgcagtgtgggggcctttgctgtaccagacagcagggtgtcctctaaagcagcagtgctccagatacctggacccaaaggcaggaagagatgaacagatcaaaatatttgaatactgagctcaaaacagctttgatggaatcagattcctcctccctttctttattttttaccctggtgctaggaggtggtgtagaggaagggtgatcttttcacaaatggtgctaagacgattaacagtttacaaaaataaaataaaattgggtgtctacctccccatacaagaaatcaactcaatgtatgggtagtatagctcttaccagataatatagataatatagattatctggtgacctgtgggtaatagaagatgttttgaacagaacatgaatgcactagccacacaggatgaatgatatatttgcctgcaataaaactgatcactttatttcatcagaggaccttcatacaggagtgaaagggcaaggcacggagatggagaagatgtttgtaacatacatagcatttaattatatgaagttcctaaaaataaatatgtaaaagacagtgctattgaaaattggagttgggcgtggtggctcatgcctgtaacccaaacgctttgggaggccaaggcaggaggattgcttgagccctggaatttgagaccagtctgggcaacatagcaagaccctgcctctagaaaatgaaaaattaaagagctaggcatagtggtacatgcctgtagtcccaagctccttgggaggttgagttgggaggatgtcttgagcctaaggattgagcctgcagtgggctatgatcacaccaatgcactctagcgtgggcgacagagtgagaccctgtctcaaaaaaaaaaaaaaaaagaaagaaagaaaattgggcaaaacactttaatagtgacatcacagaagagtgaagactccgtccccaaaccatcagaaggtgcccagcttgacagtcctcccgacagggacccaggaagccacaggaggcccaggccctctccgaagaggccagagctgaccctcctgacagtggcaggagcgggagtctcagactctggggccctggggtgaggacgtgccctgcacagtcccctggggagaccccggcacatccatgagcggagatgtgcaggtgtcaggaccccagtccctgccctggaggatctgtcatggcggccctgcctggggcagcccttggtgccgtgcgaaatggaaggagaaactgtgttccttgtgctgggaggtggtggggcttctcctgaccacacagccagtgcagagcctgaggctggtgaaggttctcttgctccctcctccctgcccaggccttctctccccagtgctgccttcctgaccttgatggtggtggtcaccctatgcatccctgccttccccagagcccaaggcggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcaggtcagtgctttggaggtcctgaggagcctcttcagaggtgatggtgcttctggctcgtagccccagcatatctctgtgcactttccttcagccttcatgtctcgggcttcccatctttccactcccatttccatccctgtggctgggccaagggaggggtgtgcatgggagggagaggggctgttcctgcaaacccggaggcatgtttgtacttggtagtgcgcagtcacacctgcggggcaccttcctggttttcttagtgtccaaggaggctcgctgcccctggcactgggggttgaggtggaccgggtgtctgtcacatgcacagaggtgaatgtgctgttgttgaatgtctggtagctcctgagtcctcaccctatggagcatatggctcttgccagggggaggggagatgcctccatttcatccaaccaagatcatgggagttttcagtcaccgaattgtccttggaattttcccaaaactaaaatttggcttatcatagttttagagaaaggggaacactcttccctcttcccatatgttacaaaatgtagatccctgatttgttgtgattgtgtgaatcgtaaggagtggcgccccagtggagatgtgcctgcagtgcatccatgggcttagaatactatttctaaaacaaagcatgttttccttttgtcctcaattggagtatttggtgtcagtgttcttgtagtttgatttagaaatggaaaagaataagtagagtaggtgacaccaccacacttcgtcaaaggcgagttcccttcatagcagcctctgtttgacatgtgtatttactttatagaatttcctaatggttactgtgtttgagcctccatggctgcttcatagagaagtctgagaaacaaatttattttcctttcattaagacagtcttactgtccagtaaccctggctgtaggtactacactgacctctagatgccaccacataacagtttgttattgcatcagcatagagtggttttgggggtgtatatacacccaaaacctcactctgtatttttgtcaaattttaagagaatatgacaaattattttatagaaatacatttgtggtaataaattttatagtaataaatttgaaaatattgacaatttggccagttcctagaaatatatcaaaagtgacacaaaaataagtagataactctagtagtcctagaaacttaaaaaaatggaaccatgaaaaccatctgctcatagcaaaagatgtaagcctggtggctctaattgctaaattatactaaatatttaggaaagaaattattctatgttcatacagattcttctactagggaacagaaaagcagatatactccccagatagtcttgtagaaacatgatatagcctagggcagtggctcatgcctgtaatcccaacactttgggaggccaaggtagaaggatcacttgagctcaggagttcgagatcatcctgggcaacatagcaaaaccctgtctctaaaaaacaattaaaaaattagctgggtgttgtagtgggtgcctgtaagtcctagctacttgggaggctgaggtgggaggactgcttgagcccaggaggttgaggttatagtgaactatgatggcaccactgcactccagctaggtcaacagattgagactcttgtctcaaaaaagaaaaaaaaagaaaaataagaaatataatatggatatcaaaatatgacaaggaatgttaacaaggattaaaattttagaccaatctattatggatatcaaggcaaaatattagcaactgaatttagctatctatcaagaggataagaccctctaaggaaggatgtagtcccagaatgcaaggctggtttagttttagaaacaagtgcatctatataaaggatgatggaattggatgcaatgaaaaaattatgtgatctcaataaatacagaatacaatgtttgattaaatttaatattaaagttcagaggtaatatttgataaaattcagcatcaattcatgccatgaaattcttaacaaattataaagtatcgttctttaatctggtcagtggtactgcagaaaacaccaggtaactgcatatttaaagagaaccttgaaagctttgcctttgagataggaatcagcacgtagaagccaaccatcccaacttccattcagcactgtacagcagagaaaggaggaaaagaaaagaaaaggtataacacttggagaaaaacataagtgggattcacagattatatgagtatcaattcagaaaatccaaaagatagataaataataagataaataataagttataacaaataatatgagagttgagaaacatcacatagaaattcaacatgcagaatacacatatatatgtatgtatgtatatacgcatacacacacacactagcaacacagttgtaaaatgaaattttaaaagatttacaagagcgtgaaaagcatcaagtatagtaaagatgtctgatacctcagtggaggaaaattgtcagatatttttgttgttgagtcaggatctcactctgtcacccagagtggagttcagtcgtgcaatcatggctcactgcagcctcaacctcctgggctcaagagatcctcccacctcggcctcctgacttgatgagaatacaggcgtgcaccaccatgcctagctaattttttaaggaatttttttggtagcgacagggtctcactatttcgcccaggctgggctcaaactcctgacctcaagcaatcctcccacctcagcctcccaaagtgctgggattacaggtgtgagccactgtgcctggccattgtgaaacatttttgacagacagtaagaagacctaaataaatagaaacccatggaagactcaaatatgttaatgcccagtcaaaacccaagcaaatgtttctctttggggaggtgaacgttgagaagcagattctgaaggccaagtggagtaacacactcttgaagagccacttgtgagcatttgtctaccagatatcaagaacattcagctgcaggaatggagacagccaggcacaacacaaggacagttgtcagaccaaagggacagaatcgtgagctcatgatcagacccaaatacatggattctcccttttattgcttcttgttttttttgtgtgtgtgtgttttgtgtgttttttttttaaccttcacacctgcacaggcagtggagaaaggatgatcttctaaaaaaaaaatagttctttgattgtttaaccttacaaaaatttagactagtaacttatttcacactgaaaagtgagttccaggaaggttagaggccacagagtataaaaggtaaaaccataaagcctctagatgctaacatagattgctaaaaacttcagggaaaggaaagatttcttaaaactaaacagtggaacaatggtatatttaactacattaaaactaaaactttaatttgtcaagacatcatttgagagcgaaaaggccggtcaaggacatgggtaagatgtttacaaatacacagttatcatttgctagcatttaaaatatataaagagttcctaaaaataaggaaggaaaagacagaaaaggctactgaaaattggacagaagcctgaagagcgacaccccagaagagctgacgtaatggccagaagtggtggaaagggctccaccttgcatgtcaccaggcaatgcatgacaaagcccaggccttccccgcagaggccaacgctgaccctcctgacagtggcaggactggaagcctcagtactctggggccctgcagtgaggacacgccctgcccagtcccatggggagaccctagcatatccttgaagggagctgtgtaagcattaggaacccagtccctgcactggaggagctcgtgcacggagggtttgtcacaactgccccgcctggaatagcccatggcactgcacagtggatggagaaactgtgattcttgtgctgggaggtggtggggcttctcccagctacatggccagtgccaagcttgggaaggttctgtttctcctactttcttgtctaggccctcctaccctagggtggtcttcctgacctgggcagtatctttgacctcgtgtgtccctccttgtccatccccagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcaggtcagtgctttggggatgctgagtgagccctgtttgtagctgctgctgtgactggagtagaaccactgctgacccagtgggctttccattagactccatccctcaacttctcccatcctctcacctcctatttttatgcctgtggtggagctgggctgcttagtggggaagggagtgaacggaagggtcagggccctccttgtccatgttgggtggtgtttctgtgcagacatgctgggtcacattttcccagtaccttctccaaactaccgatgtcccgaggtgtccaggactctggtcctatctaatgcatgagatggcggtaagccagacgtccctccctcggggatactcctgcagtccctgcacggcctcatctggccccatgtgagggctctccctgtggaaagagattttaattcgttgagtcagggtgtagggaaattccagccacacagtcttatttggaattatatcaacactgaacactgggttcccaaagttttcagtgttctgggacacacttctgtccttccctgtggatgtagaagccctgtcagagccctgactaaaacccagatccacagcgttagtgtgtgcaaaacgagtaaagagcagcacattggcaggtgcgcacacgtgacgttggaattccatttcggaagccaatctcactttccttttgcattctgttagaatgttctgtgtctgaattccccttggaatttggatagatttaaaagtgataggaataagtagctggtgtttctagcctccgcctccaggcgggtgaggaggtgacacctgagaattcctccctctcacccctgaccctgccggaaagcgaaactgagatgcgggcattgggccctgggaagcgtggggaaggggaaaggagaaagccaggtgggtttttaggtcccttccagtgccacactgtggggtgttgaggggccgcgcgaggcaggcccttccatgaggcctggactggaggccttctctaggcgccggcgtggcctgggccgcctgccgccacgcaggggccgcacgcctgggccccagggcccctttgccggcgggaggccggggggaccgactgctcttggcgcccggggtcaggggaggccgggaaacctcggctcccgggcgacaggcacccaggcccttctcagccccccggccgcggccgcgccgggcctcgcttcagccgggcgattcttcccctcatttgttgcattgtttgcattaatatgaatatcttgttctgtttgttttgtctcctgagagccaataaagctgtgttttttctttacaccaaaaaaaaaaaaaaaaaaaaaaaggaataagtagcttatggcacagtgacacactggtagaattaagttatggtggtagcagtcgctgactggggaagccatatttacatcatcctgtttccttgatgagtcctgtgcctgccccctctccagctgattcataggaagtctgagaatgacctttactttcctattgtttgttaggagagtttaacttcaaactccaaccctgagccctgagtgccaccacataacagttggtgttatatatatctaaaatggtttacaaatgtgtagataccaaaaatactcactgcaagtaaatttgaaaagtgttaacaaattatataatttctagaaaccaaaaacagacttaagaaatagataacctatatgcagttatctactgttactgaagttatctcagttactacaacctagtaaaaactagaaccggtagcgaaaaatcttctcatcaaacatgtggccctactgagaaattcttccaaacgttctggccagaaattcttccatgttcatggaaattcttctggagaatggaaaaaggaagatataccctctaactcattatatgcagatagcttaatgccatgactaaaatctggccagaagataggaagtttgcacattgtagatcaaagaattatggatatcatggccaattttttaaacaaaacattagtaaactgaattcagcaatacatcaagacaatcatacaggatgatgaaattcatagtctaggaatgagggctgctttcatgttaaaaacattagaaaatcatgatatgtgattgaaatttgaaaacaatgtaattatcttaaactcagaataaagtaccatatttgataaaaatttaacctcatatattcagaagaaatgtctggcaaaatttagcatccatcatgccataaaattcttaacaaagtataaataaaagtttttttttcctaatttgacacagggtattacacaaaaatcacaaagggagactttgtaagctttgcctctgagccaggggacagcatgaggaagccagtggtcaacacttccatccagcattggatggcacagttaggaggaaagtaaaacgaaaggtgtaaaagttagaaaaaagtgaattgacagaatatacggtttacctagaagataaattattagagagttgagaaagatcaacccttgcaagatctgtgtgaagaaacttccgtacatgtagactagcagcaagcagttggaaaatgaaaacgtaaaagattgacagacgcctcaaaggcatcatgtttatgatcccagtctaataaaagatgtcgagaggttctgtgggggaagctatgaaacacttttgagagacagtaaagatctaaagtggatagaagccatggaagaatgaaagacgttcagtctcaatcaaaatccaaacaaatgtggttttgggggatgcaaggttgaaaaatgacaagtggatttaaagctccatacatgcttgaagaagagccgcatgtgcaggtaccctagtccctgccctggaggagctcatgcatggagggtttgtcatagctgccccacctgtgatagcccatggcgccgtgcacagtggatagacaaactgtgattcttgcgctgggaggtggcaggacttctcctggccacgcagccagtgcagagcctggggaaggttctgtttctcctacttcctcatccaggccctcctatcctagggtggtcttcctgacctaggctgtatctttgacctcgtatgtccttccttgtccatccccagagcccaaggcggtgtttgccaaggagcaggtggtgtttgccaaggatcagccggtgcacagggaggtgcaggctgaggcagggaccagcaccatgctgagctgcgaggtggcccaagcccagacggaggttatgtggtacaaggacgggaagaagctgagctccagctcgaaaatgcgtgtggaggccgtgggctgcacacggaggctggtggtgcaggaggcaggccaggcggacgccggggagtacagctgcgaggctgggggccagcggctctccttccatctgcatgtggctggtgggtgccagggttaggcaaaatggaggtgatgctgagtgtcgggtgtgaaactacaagggcatgtttgggcggcccaaggtgctgtgggccctggcaccttccctctatgtaggcctcagaatctgtgtccccagctctccccagcagctctcaggccagtgtccttatgtcatgagactagagcaggcccatgggctgagttgaccatggtgtgtgccctgcagtggctgagccgggggtggtagggacagtagcatgatgtccttggggtgtgggtctggggtctgggtccggtctcatgtgaggacccctgtctgggtggtagggacagtagcgtgatgtcctcgggggtctggggtccgggtctggtcagatgtgatgatttctgtctgggtggtggggacagtggtgtgatgtccttggggtgggggtctgggtctggtctaatgtgatctgctgactcctctgtgggtgctgggccatgggagggcccggcagtgactggagagcgtgtactgggtggtgggggcttgtctctgtgctctgggccctagatctctgtaagcctgtgctgggccccttggtcatcaccatgtgtccacctgtctttctgatatccatctcccttccaccctgtccctgagctggggacaacagaccacactcagcttggcaccctctttccaatggccctgccaacactccgctgcctctgggctggcccaggttgctggtccatctctcctgacccttcacgtcctactgcctgtggccctgcgtggtggggagggctggcgacaggtgagggccccagggccctggaagaccgaggcagggaaggggccgcatcctgttcccaagggacatgatgatggtgctgccaacatgcagccttagacctttggctctggtagtgccggggggagctctgtgcgtcaccgtgcactgcttaatgatggacagccctgcctggctgtcactgggctgacacatgggctgtgtctgctctggagcctctgaccctgcatccctccttgtccatcccagagcccaaggtggtgtttgccaaggagcagccggcatgcagggaggtgcaggcggaggcgggggccagtgccacgctgagctgtgaggtggcccagggccagatggaggtgacatggtacaaggacgggaagaagctgagctccagctcaaaagtgcacatggaggccagcggctacacacggaggctggtagtgcagcaggcgggccaggcggatgctggggagtacagctgtgaggcggggggccaacggctgtccttccgcctgcacgtggcaggtcagtgctttgggtgaatccacctcgcctgaagctgatggccacactgtatggtccctgggattctggatggtagttgatggtgctcaggactgcactgggccatccttgaagagcaatgggtatcaggggtgccaggtagcattagggtggccctgaagggagcggggccggtccagggatgacagggtccccctctcatgccaactcacctctacccagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaaggtgagccgggcatggggcgtggggcggggactcctccagacacctctgtcccagagctggacaggggcgaagctggggctcaagtctggtctgttaagagcccggctgatgtcccctttgtgcccacagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtggtatgtaaggggtcgagtgtccctatccagggcagcctcctggaggaggcggcctttggtactcctgcagcgtaagggctctgccagtcctgtgcgcccgcctcttaagcagtgctcctgtctgcagtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgaggtgagtgtggggggcagcaggatttgcctggctggccagggctccttgcacaggcacctcccctgtgggctggttctgagtgggcacctggaactgctgtcctgttacggctggtccggctgacctcaggagacacggggtgtgtgggctgcagagaggagactccggtaggctggatgggccaggtgccttctcttggtatagagaagatacaatcctgcagttgcacctggtggggaatggggggaggctgaggcaatccagggaggctttctggagtaggtgggtgcatacttagcctgatggatggcagggaagagagagtggggttagcaccagtgcaagcagtgacatgggcttcccatgctgctgaagccagaagccagaacttgccctgaagggaagtgggagtcatggcaggttctagagtaagggagtgatgcagcagattcaccttctgcggagttgacgggtggcctgaggcagagaggcccgccagcgcctcttccttaacctgcgcaggagtcctgggctttgctaaaccgccgttgcgcctggggaagctctgtcttcccccctctgcagttcctgccagtgctactagtggggatcacgtctaggatttcgaggcacaagggcctggcgtcttgttcagagcaggggagctggaggtgggagcggggcttaaggaagcttcctggtttcctcgcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagagtgagccgcgggcgggaagggcggggcatcgaggaggagtgaggagggaggcggggcattgaggattagtgaggacgtaggcggggtgctgaggggaggagggaggaggggcactgaggaagagggagcggaaaagagaggagggaggtggggcgctgaggggaagagagaggagggaggtggggcactgaggggaggagggaggagcgaggtgggacactgaggggagtggcgggccctctggaagggccgtagggttgggagaggggcaggtctcccgcccgaggggcgagcggtgggggtaggcgtggggcggcttcccggccctccccgagctcctggggaagccggctgtgccccagggttctaaaggcggtggtctcagagcagcggctgacccgtgacaccgcgtgtgcaccgcagtgcgccaggtacggctcgtacggggcctgcaggcagtggaggcacgggagcagggcacggctaccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccggtgcgttggggggccggcagggcacagcacagagcacgcctgcctgtcccgagggggccccgggaaggtcggtgggttctctggggacctagatgagccagctccgtataactccgtccagctggggcactgccccacccctgtccctgtccccatcctgaaggcttctccaagccctttttctcttcccacctcctccttcctcctccccagagcttcccgtgagcttcagccgcccgctgcaggacgtggtgaccactgagaaggagaaggttaccctggagtgcgagctgtcgcgtcctaatgtggatgtgcgctggctgaaggtgcctccctgccgaccccactcggttgcctcctcccctcctctcatgtgggcgggcccaagcagaaccccagggctggaccacctgagtgcctgactcggcctctgccctgcacaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggtgagggctgcgtggggcatgtggggcatggcaggtatgggcacctcctcctgtcctccgtgtcccccagccaggggcttggcagctctactttcacctgcacaacccttggcatgctggggcactgggtggggggtgctgggagcagctctgtgtgtccgggtgtggcagggcctcccttgccaccctaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggttcgaggacaggcggctgtagcaggcacggcccggcccccaggtcttcctctgcccccgcccatactgagccgcctttgtccccaggaaggacatacactctcatctaccggagagtcctggcggaagatgcaggagagatccaatttgtagccgaaaatgcagaatcgcgagcccagctccgagtgaagggtgaggtgggggctgaggggagggcggggctggacggtgtgcatgtgtggccagctggctcagcacaggcccggacgccccaggcctgctctcaggacgaggacagcagggactcaggagggaagggggcgtcacctccttggcaggaagataggggccagagaagcggccatgaggggcttctcccttccttaaaacagatcctgaagaattctccctcgggctgcagcgagtgctggagaggccaggcatgaggtcctgtgggggaggcatggcaggggcggggggttctacctggtggcagcgaggaggaggatcagggaaagtggtgctggggtggcagggagggaggctctgcagacaggtggggtggggatgggccagtagggctaatcagaggtatgcggggagggacatgagttcctgggactgagctagggtatgtggttatggttcggaagtgggggtttggggagaggactgcagggggtggggctacatggggcaggacctaccctgctcttggtgggccgggacagcgggtaggacctgggcagtggaagtgggagtgtgggatatgggagggcagggcgggcagaggtgggcgcactccccttgcttgtggtctgctctgtggagcaggtcctagcacagctccaagggggacacttggcctgaccacctgctggcccctggcgggcagacatgggctgttggggcctagtggggtccaactgagggcccaagaccctcagtgccttgtcggagcctgggcctgggagcctggagcaccatctctgatccaccccatgcccccaccacgttcacagagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaaggtgcaggcagggagggcagctctgcaggttgcttttgttggggggagtctcccaggtccatggtttgccctacactcctggagacgctgggtctgggcagctcaggaggatgctagcatgcatctagcagggcgggggcttgttcccaggaaggaaccctgccggaggggcagcatgtcctatccgcgggatccgccagcgactgctcctccccaacagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcaggtgagcactcccgccccggtgggtggacgtggggcagagccacaagaggacaaggttcagggctgttgggaggcctggacagggctgtgggtgggtacagggcagggccatgggaggagaaggctcagggcagtgacaacacagttcagggccacagatggatatcaattagggccaggggaggacacagttcaggactgcagaggacacagctcagggccaggggaagacatagttcagggaatggtggacacagctcagggccaggggcggacacagttcaaggccataggtgagcaggctcagggcttggcaggcagggcagggtgattggttcctgtggtgccgtggcccagcctctccccactccctgcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaaggtggggcatgaggggcatggggctactgagagggttttggggaggggttgcctggtgatgtggacactgaggcccggtgtgtctcttgcagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgaggtgagtcatcccacgagtcttcgggactccccactaggaatgggacaggcgctggcctccctcaccctcctatccctcctgcagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacgtgggctccgaggagacccgggcccgggtccgcgtgcacggtgtgtggctgcaggcacggcagagctcagggaagggaggcgtgctgggtgggcatggatgtggggccagccactacctgggtggcccacatcattctctgagattgaagggctgctctgctgagccggggaggtcaggggagccttctgggggagccatggcttgatgtggtcctgtgaggcctgggtgcaagcaggtggacccggggacagtgggtcccggagccagaaattgtccccggagccagggttggaggctgtgctgtccctgcccgctggtcccgacgacatagcctggggatgttgccctgtaccaggggacgtgtctgcatggaagtcatcaggccactgtggggacaccagtggggatagccagggagaagccgagatgccaggcaggggctgtgagtaggccacgtctctgtccttcacggggccccagcaaggccctaaggccactgggctggcagggtagagccatccctgaacccagccctgcagccttgggggcgtgcgtgccctggaacctgtcctgcttttcaggggaagttccctcaactgcagggtggctacctggccccctctgtgtgtgtgcccggtcccagtggcatcctggtgtgggtgacaggtggtgtaaccagcctgtttgctggtccttgacagtcttgtaacgagatgggaaggggcaggaggcatggtgagtttgtcctggagctgggactagcctgcctggaggcccctcatccggggtcctgtgcctcctctcctccctgtgatgaccatgggttctccctctccctgccacactgattggatcagagctgttggttatgcagatgccaggggcagccagctccagcagaggggcatctactcattggctggtgcaatgtggcaccctgtcccccagggcctggcctctcccagggtctggcacctcccagggtttggtccctgtggggtctggtccctctaaggaatccagctcctcctggcgtctggtccctgtgggctctgatccctcctagggtctggtcccttgggctctgatccctcccagggtctggcccttcctaggtctggcccagggcagtgctgtcctcttgcctggcctgacagtctctgatggcccgcagatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagaggtaggcagggcctgccggacgggggcttatcacctgggctgaggagtggggaccctgggcctgtccccaggagtccaggagctgggcccccctggctacagaagctggtggggggggcttttggggcctgcctcccccagctgctgcagagcaccccttctagaagccgcagggcctgagtcacctgctggatgctgggggcggttctcgagtggaattggggttgcactcttttctgagctctgatataggcctggattcttttccaatccgtggtctgagtgccctgagcacttggtagctcccagagctgtgactcacagggccagtctggcagcactggcctgaggccccagccacctgctctgctgacatcaccgccagcgcccgagttcgcgcccctgacgagcacacttggtgcagctcggtggggcacactcagaggatgccagtgtgggcctgaaagatgccaggggataaaattctgtagtttttgatcttcctgcctcccaagtcccaccgtggtgacagtggggacactaacattccaggactctgaagctcctgagggccgaggtcccagagtttgggggttgcaggttctattgtcttggtcaccagagagtgaatgttgtcaaacgcttgtccttgccccaatcctggtcatggtggaggtggtaggttttggctgggtctgtgcctggggctatggctgtagcccagatggtggctggggctgtggctgcagtcatctgtggctggtgccgtggccctggctgtgcttcaagggcagctgtccctgctcccttcagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaaggtaaatgccgcaggagccccacgcgtggccctggagtggcctctctgccctagcggggcacggggccacccctggagcctgagctgctctgtctcaggtggaagggctcaactcaggtcccagagcttctgcagccgggcctggaagataacggggccggcctggggtctgtgcaggcctcacgccccacctattctgcctccatctccctgccccagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggtgaggcggccaagtgtgctcgggcctaggctttgaatggcacggagacttggaggtggacaggcccagcctcagtttcttatcatgagggtatagggggtgcaccctgggtggtcactgaggctccccagcatggctgtgaatgagctgctggtgctcacttactcgtgtgtttatttggtcactgtgtgtttctcccacatgccccgtgtgcctggcccccatgcgtaagctcagcgtgtatccgtacataaaacgtgtcacccttatcccagagggacagcctgactcagccgtgccaggcagcctcaggtgctcccagggaagaactgatggtcattagggttgtcattgagagttacagtggcattttagtctttttcttgttgtttacaacagaatacctgaaactgggtaatttataaaggaaataaatttacttcttacagctctggaggctgggaagtccaaggtcaaggggccacatctggtgagggcccttttgctgacaggaactctctgcagagtccccaagggacggcacagggcatcccatggggagggggctgagtgtgctagcttgggcctctcttcatcttcttttaaagccaccactcatatggaagcactttaacccattaacctgttaacccgttgatccatgaatgggttaatccattcccgccttggacccaatcccctcttaaaggctccacctcttaatattgccacattgggattaagtttcaacatgagtttccagggggacattcagatcatagtaggtggctgttcgatcttactgtttggctccacatttgagtggcaggcagagtgagagctgtcattctctcaactctgtagataagaaaactgaagctttagtgggtccatggccagggcaaggtcatcaggcacattgggatcagagcaggcgaggcccagccccatcaccgcagccttcacttggctctgaagtcccgggctggtgtccagagctgagtttgcaggaggtccctactggggtctgaccacagggcgttcacagggttcagtatttgaaaggccccagttgtgatcatcagaagtaacgtaaaccaggaatcatcactgattttttctctccaatggatttggtgaccctggtgaaagtattctgttagcacagtaacgccccatgatctaataaagttggtacccagagttaatttttaaaaaagtcatcaagagtgagagtcataagataacaaaagatgctcttttaaagtttaacatggctgggctcagtggctcacgcctgtaatcccagcactttgggagtctgaggcaggtggatcaagaggtcaggggttctagaccagcctggccaacatggtgaaaccccatctctattaaaaatacaaaattagccaggcatggtggcgcgtgcttgtattctcagctactcaggaggctgaggcaggagcgttgcttgaacccgggaggcggaggttgcagtgagccaagatcgcgccactgcactccagcctgggagacagagtgagattccgtctctacaaaaataaaataaaataaaataaaaatttaacatatgaggatgtcgactggcctggtctgggagtccaagccatttccctgtttgccatccactgatgggagctcttcctccgtgtgcattgcccgggctggggtcagcttctttgaggtggagttgtgcctgcaggacactcgtgcatgcagaaggaatctgaacgcaggacctgtctctatattcataaacgctcatctcttaccatccctaattcaacagccaaaaaaccttgtttctaggaattcacatttcctatcttccaagcatttgatttaaatttcaacataaatgtagccatttttttttcacactcctgtttcatctgttactacaagagttaatttcatggcacaattgtaatgatacacacagctgtgtaagcaggtttgggagccaaccgctcctgggagcacagcttggaaagggggcaggagtgtgctctcctgggttctcagcaggctgcagactcacccagcaagccttgcagaaggacctccaaggtgcagagaggtgggctcggggctccgagtggccctcaaacaagtacctttggaccattcaagctctgacccacttactgtttccagagttctgtccctgcaaacttgttaaaacacagccaccttgctctgtcctggggagcgtctgtcctggggagcactgctggccaagcctgcccaggacggtggggcccctgagcagtctgtgcctttgcaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactggtgggttgcatgcccgcattgcacatgttgctcagagctgcagacaggtggagaggtggatggcagctcagccatgtgcccagtatccctgggctcacagagaaagcaccattggcttactgtggggtgggggctcggaaggctgaattgggctctttcaggatggatgcttctgcatggtttgcagaactgtgcttggcgtggcccgagccaggctgcatccccactggggcaggagccgcacggagcctgccctgttccctctgcagccttttgcgtggccccagcgtgagggtggctggtgggtgctgagccagggtgttgcctggtctgcagtgagacccagggtttctccccgttggcccctccagcggcagcacgacaggatcccacatgctcctgcttctctctctgtcccccagagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatggtgagccccagcagccccaaagcccagccacaggccaggtgcctatagctctcttctcaggcagcaccgtcttcagggcagggcatgtgcgcccacaaggagcccaaggcaggagcacccaggctcccgtacatcctgtatggggcacccatggctccccatgtccttcctggctctccctggcaccttgtccaccctgctcggcttccgccctggcctctgccacctgcaggagccgccccgcagagctgtctcctctgcgtccctgaggggacgttccctctgtgcatgcctgtgtccctgacctcccatcttaggaggtgccagccacagtggcttagggcccaccgtgacctcatttgaccttactttcctcatcacagccacgctttgaggtctgggctagggcttccaactgtgaatttggcgggcacaggtccctgacaccccactcttctgttctcctgcttggttcaccctttctatccctcaccctcagagctgcccctttccagaagtctcaaggtcgctgccacaggccccaaaggagaagggggaccctgcagctgatgtccccagccctccaccacctataggggacccctagtggacttcagtcgggggagggcaagctgagcctgtgcctgtctgcagcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactggtaagtgtctctgtccaccctgcccatgtggcccaaagatgcctcttcctccaatgcaggggagcaaagacgatgctctctgtgtctgactttcctgcagccctgcctgcccagttcatcgggaaactgagaaacaaggaggccacagaaggggccacggccacgctgcggtgtgagctgagcaaggcagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcgtaagaccgtgtatccagagccgtgtccggtgtccaattttttacctctgctgtcagtcgtacccattctagtctaccctgactgtgccatgcccttcccagcacatcacggaatcccttccagctttctgggctgtggaaggaaccaggagaacccggcatttgcagccagactcccaccctcgaggcaccctgggacctgtcctgtgggagtctgtcttatcctccgtcttgccatggcctgtccccctgtgcttcccagaatctgatctccatgtctgtctgtccatctctccccagccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaagggtaatgactgctcctggccacgtgcatgggtggctatgtctgagcgggtgtgcacattcctgctttgtgctcacgtctgcgctgtggccttccctgtctttctgcgtgtggttccttcattccttcagtagggattccccacacctgctgcgtgttacccgtctcaggagcaggaagacagcagagaagagagggctgtttgagccctacagagttgtaggcagagacagaggatgtggggagaaccaaatcattacaaaagtgagatcacagatcttctccagggtaaacactaggaaggcaggaaggcaatcaggaggagccccagaagcggaacacagacgggagtggggggatggcaggtgggctggagtgcacagccaggaaggggagggtccattgtgaggaggagagaggcagggtgactgtggggaggaggtgatgggggtgactgtggagaggaggtgatgggggtgactgtggggaggaggtgatgggggtgactgtggggaggaggtgatgggggtgactgtggggaggagcagccacagtgactctttgtgtgtcagccaagcagagcagctgtgtggagtggcagaaggggcccaagacaatctgaaatggaggctttgaccaggacagaacgtctggagccctgtggtccgcctacggcagatctagggtgtcctcacgtgtgggcggtgggagtggatctcagccatggctgggtcccctagggatgtgagactgcagaactcgccctgggccctgaacctctcagtcacagcaaggagaggattctagcctcaagccaccagtgttctcagcagaaggggcagagccctgcaggcctggccttgtgtgtctgtggagccgggacccatggcccggtgtggctggtggcgtggtgtggcgtggcgtgttcaggtgctcggggccttgaagggcctggctcacttccgtcagggaaagcacatgggataaagccggcccaggtggagggctcgggcaccttacagggaatgcagggaaggactctcccaagctcaagggccttctcgcccaggactggtgggctcccctcacaccacaaggagtgaaccctcagccagtgaaggggcaggttctgggggccaggcacagccatctggatgccagtgcctgaagcaggtagctccggtcacaggcacaagtgttgtagacctttgcggagaggccgggcctccatgcacctccagcggtgtcgacagagcacagacagcttccaaggcatggaggcaccacactaccaggcttgccaggacaccccagaggggcacagacttcgggctctgtcacatggctgtgtagcatgttggagagacacagagaccacaggcgcccgggggctaatctgtgtcctcctcagaccggtggctgaagagcagatgaccagagtggacccctgccggctgcctgaggcagttgcttccagaagtgggcgagttccgggaaagcttcaggtggtgggtgccctgctggaccccctctggtgcctgctaagagggcacccttgcatgctggaagtttccaccggaccctgaagccccaaggatgctccgagctgcagttccccagggggcgtccaggggatgaagctgagcactctgaggctccagtctccatctggtgggctgggaagccacccagcctcagtgcacaggagacagtggccctcgtctgtccctgtgatccatggctatctcctgcatgcagggcatgtccgggtggacggttccttcatgtattcagttagttgtttcttatctgctggacccatgcaccagggcacctgctgcgtggggttcctgcttgcatcatgaacacagggtgacagtcaaggtggagggcggcaccctcctctctcccagcagcaggctccttactccctgtctgccctgggccctggccgccggagcagcaggaactgatgagaagcaggagcttggatgattttgtgggagatttttaggcagctgattttgtgtcttttttctccagctattcatcaagatcatgaggctgggtgtggtggctcacacctgtaaacccagcactttgggaggccaaggcaggaggatcatttgagctcaggagtttcaggccaacctgggcaacccagggagaccctatctctacaaaaaatataaaaattagctggttgtggtggtgtgcacctgtggtcccagctactcaggtgggaggattggttgaggccagaagtttgaggctgcagtgagctgtgatggcaccactgcactccagcctaggcgacacactgagaccctgtctgaaaaagaaaaaaaaattatgaaggagctatgaaatagggagccacagaatgaggccagggccacagtatagtgtgagccaccaggctggtcttgggcccttgagcatgatgacaaattcagtctgagccaggatgggctacggaagaccctggggatggggagatgtggtttggttccgtctctgcctccccatctcatgggtcctgtggccactgcatgtgtctgccatcatcttggggtccctgctaggattccagctcctctgtgtcctgggcggctttcccctgtgtgtccatggccagtctgttctctgttcccagggcactgtttcacgtccacatgtccatgctttaattcctagtttcctccagagcgggagtgtgtccttgctgagtgtccccaggtgtctccagagggcctcatggtttttgtgtcctctccagccttgccagccaggttcatagaaagtatgaggcctgaggatgcctcaaaaggggccataccgtggtgctggtgggctggaccgtgggaagccgcagtgcacagcctgtactcagcacaccccaggagcagcccatgttcagatggcttccctgtcttctcagtgttgtccatgtcctgtctcttctgtgggctcagagggtgtgactgtggccatctctttctgatccctcagccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcaggggtaaagatcatgtgtggccttgtggacccgtggcttggtgtctacatgtcactgagtcatcctcatcttccaatgtggcacagcccctgtggcaatcccggggttgtcttttctccaactgaggtcctccggttgtctcccgcctactcttcttgtccaggaggtgtcctcatgctcatgttcatccctttgtgttctctgttcttcccgggccatttgcttcctccccgtgtgaatgtttatttgctccttcacatgtggtcctttggcggtttgtgtggctccttgtgggtgtccatgtcccgtccacagagtcttccagacagtctgatgatctcagcgactgcttggtccttcccagctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcaggggtaaaagccacatgtggccaaggagagccctcttctggtgtccatgtactgatgtcatgccgtctgtctgtactcaccccatgtgctctccctgcatctgcgccaccctgttcccatcactctgcggagtcccttccagcctctagagctattgtgggaaccaggagaaactggccttgcagccagcttccaccccatgtgcctccaaagatgggctccatcatgttgtcctgttggcttctgcaccttgtccttcatgctgtcctgtcctccccccacagagtgctccagagactctcacggtcctcatgtgtgtctgacatactctggctctggcagccagagttacataaagtgtgaggactcaggaggccatggaaggagccacagctacagcgctgacaggctggagcatgggaagccccagtccacagcctgtgctcagcacaccccacatgtggcctgtgtccagttggattctgtgtcttctctgtgccatccatgttctgtatcttccatgttctcagagagcatgattgtgttcatatattctgaccctcccccagctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcaggggtaaaggccacatgcagccaagcagcaccatgctctcatgtccacgtgttgacttgacgccatccgtctctgcctatgctgcgttctctccccatgtctgtgcctgcctgtgtaactgcacgagcttcttccagcctccagggctgttgtaggaagcaggaggaagcagcctctctagcgggctcccactgtgtgcctccgaggactctgtcaacattgtcacgttggattctatgtcttccatcctgtcacattctttcccctgatgttctccatgtgtttctgaccctctctgggcctgggtgccagagattcctataaagcctgagatgtgaggaggccacaggaggggccatggccatgtgctgtacagtctgtactgagggaagtcccagtccacagcctgtgctcagcacacccccatgcggcctgtgcccagttgggttctgtgtcttgtctctgccatccatgtctttcctatctcttccaggtactcagagaatgtgattatatctgtgtcttttgacctccccagccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggacgggtccaggtgtgagctgcagatccgtggcctggctgtggtggatgccggggagtactcgtgtgtgtgcgggcaggagaggacctcagccacactcactgtcaggggtaaagatcgtgtgtagctatgtggaccatggcttggtgtctacgcatctctgtgtcaccaccttctgccttcaaatgtggcatggttctgtggcaaccccatggttgtctgtcctttaaccagggtcctctgggcatctccctcctcccttcttatccaggaggtgttctcatgctcatgtccttctccttttgtgttctctgttcctctggggccatttgcttcctccccatgtgtacgtttgtttgctctttcacgtgtggtcctttgatggtttgtgtggctccttgtgggtgaccatgtctcgtccatagagtcctccagacggtctgataatcacaatgactgcttggttcttcccagccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcaggggtaaagaccacatgtggccacctgagtgattcctgtctcctcccacctaacccacatgatctgtgctctcccagttcctcttgatgtcattgccatctcattcagtcactcccctgtgtgatacatcccacaaatgcacttggaacccacttggatgacctaatctagggcctgggaatatggacctcaggagtgaatagggcagggacccaaaggagagccccacagacagacatcagggtccaggagagctgtctggggccactggcatcttgctggggcttgcacatgtgcgtgggctctggggccccaggcctagaggtgagggcctgtgtttctgctgatggacatgcacagtagggttgggggctcaccgaggaggtggtcaggccaggccccactaaatctgctgagagtgtttgagtggttcttgtggtcatgccaggctcctgaaggactgctgcctttatctgctcggcggacacagcagagcacggcatctgggtaacttcacagcagatatttattttctcagacttctggagtctgaaattccaagatcaaggagtcacttggttggtttctccttaggcctcttttcttggcttgtagatactctggtcacattggattgggcccttcataacaacctcattttacctttcaaagataccatttcaatacagtgacattgtgaagtactaggggttaggatttcaacatacatggatttggtgaggggactcaattcagaccatgacattctgccctctggcttcccacaattaattaccgtctaacatgcaaaataaacttactccttcctaacagcccgtaatcttaacccattccagcatcaactcaaaatcaaaatctcatctgaacgcatctaagtcaagcatgagggaggtgaagtatgagtcattccaaggcaaaattcttcttcagttgtgaagcatggaaccagacaagttttgtgcttccaaaatgcagtggtggtgcaggcataggatagacgttcctgttcaaaagaggggaagttggaaagaaaaaacaggtcaggatcttatgcaggtctgaacctagcagagcaaatttcactagattttaaggctggtgactcagtacagtggctcatctctataatcctagcacattgggtggccgaggcaggaggattacttgaggccaggtgttctagaccagcctggaaatatagcaagacccttttcctaaaagaaaaaagaaattgttaggtttggtggtacacatctggggttccagttactagggaggctgaggcatgaagatcacttgagcctgggagtttgaggttgcagtgagctataattgtaccactgcactccagcctgggtaacagtgagaccccatctctacctttttttttaaagtctgaaaaataattctctttgacttaattccagtcctccatgccaaccagagtgttatccccaatctctcagacctgggtaatatcttatccactcatccttgggtaacagcctctccccctccattctgggaagaggtggtcctgatccctggacctgtagtggcagtggaagccctgctgatgcctttggggtcattcttttattttgaaggataagacatgtttgcagccatatagtgatattagctcattctgttgaatcccagaagtctgatagccttccttcattttatcccacctcaatccagttcactcgaatctgctggtataagattatcagaaactgagttggcctcccatgcaattcatggaggtccacaccatcagacaagaggcttttccagataactgcatctctattcctggcttctgttgagatgactaattggatccataaattgcacacctggtgctttagcaaatggttgtctagccacacccttgatgttctcttcagaacagtttctcattttttaccatgtggttaggctgaagaatttccaaagcttcaagtattggttccttttttatttacaattccttcttcaatttatttccctcctcttgcactttacaataagcagcaaagagaaaacaggtttcatcttcaacactttacttagaaatttcctcaactaaacatgcaaaattttattgtttcttagtcctaccttccacacacaacacaattcggacaagttctttgccacttaataatgaggatcgcctttcctccccttttcaataacctgttctttatttccatctgaggtctgaccagatgtccatcttttttaatgtccatctttccatgaacaggttgttcacagcaatctaggttttttccaacatgcacttcaaatatcatccagcctccatccattacccagttccaaagccacttccacatttttagataattgttacaatggcaccctactcctggtaccaatatttgtgttagttttctgactagatgtctgaggtgaagtgttattaggttgacttcctctgaggcttctctccttggcttgttgatgcggtcttctgttttttcacatggtcactcctcagtgtgtctctgtgtcctaatatctgctttttataaggacaccagtcatattggagttgggcacaccctgacaacctcatttaaccttagttaccactttaaaggccctatctttaatacagtcatgctctgaggttctagaggttaggtttgaatgtattaatttggggggacacaatcagaccataacggggtaaccagggtggggcttgctccattgtaccttgtgagctctcactttgcttagagtcaggagggaagagaggacagcaggttgaagggtcagaggtgtgatgtagaagccgcatctggagtctgttgggggttttggtgattgagccaaggcaatgtgtatccagtaaagtcaggacaggagcagtgaggtggagacagcaggtccttgtgtgggctgggatggttggcagtgagccgaggtatgcccatgcatgagcagtgctggatggaagccctgcctgggatgggtatctcctgtatgagaatgggaagcaggtgtcaggacaaggaggtgcctcctgtgaggctggagaaagagagagagagaagagagagatgtatcacattattgcatatgtggaagttgcaggagcctgtcttgcttcctagtaatgataggacatgggtaggacaagatgccctttgagaagagatccaggatggagcccatctctcagccaatctgcacctcataggcagaacacaggaagacctcagtctcacatggtctttggtccgccttatcccatgtcttcgagatctgcttctgtttccttcctagataatcaggttgcgtccctcagatcctccagagggtttgatggcttctgtccatgtgacccttcctagccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcaggggtaaagtccatctgtccagatctgcgttctggtgtccagttgttcacttcttgccatcaatctctgctcattgcatggtctcccccagactgccacactcttcacgtcatgccacactatcccttccagcttcctgggctgctgaaggaaccagaagaaactctcatctacatccagattccctctcctgtgatactgtgggccctgttctattggattgtgtcttgtctttcatcttgtcatgtcctatctaccagcgctttccaaggaatttaatgttctttgtgttttctgaccctctctggccctgcatggcagattcacgttatctctgaggcctgaggagcccacgaaggggctccttcgtggttacttcgtgatgttaccaggctgaacagagggaatctacagcctgtgcttggcataccctgcatgtggtctgtgtccagttgggctttgtgtcttctctgtgccatccatgtcctgtctctttcatgtgctcaatgtaattgtgtccatgtctttctgatccctccaccagccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcaggggtaaagatcctatgtggccatgtgggcttgtggcttggtgtatacacctctctgtgtcaccaccttctgcctccaaatgtggcacatctcctgtggaaaccctgtgattgtctgtcctctaactggggccctctaggtatctcctgcctccccttctcatcagtagatgtcctcctgctcatgcatgtccctgtgtgttctctgtgcctcctgggccatttgccttctcattgtttatatattgctcatctagctatggtcctttggtggtttgtgtggctccttattggtgtccatgttctgtccgaaaaatcctccagacagtctgatgatatcagtgactgtttggtccttctcagccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcaggggtaaagaccacatgtgaccacctgagtgacttctgtcttcccccacttaacccacatgttctgtgctctcccagtgtctctcagtgtcgttgacattttattcagtcactcatctttgtggtccatctcacaaatgcatgctgaggacccacttggatggcctaatctagggcctgggcatacagaccccaagggtgaatagtgcagggtccccaggtgtcaggacagggagagcagcaggcaggtgtcagggtccaggagagctgtctggggcccctgccatcttgcaaaggcctgtggatgtccaccagctcttgagcctcaggcatggaggtcaggaaatgtatgtcctttgacagacatagcgatggctcaggccaggcccctcttcaggctggtgagtgttctgattgatccttgtggtcattccaagcttctaaaggagtattgtcttcatctgctcaggctaacgtaacaaagcactgcagacagggtggctcaaataacacagatttattttctcagaagtatggggctgaaatctcaagatcaagatgtcagctcctctcttcttgtagacagctgtcttctccccatgtcttcacatggatgtccctctgtgtgcatgtgtgtgtcctaacctctttttataagagcaccagtcatactggatttggaaccaccctaacaacctcatttttcctttcaatgattgtctttaaatacagtgatattctgacgtgtactgggggttaggacttcaacatatgcattttttctgaggcacaattcagaccataacactccaccatctggattctcaaaattcatggccttctcacgtgcaaaatatgtttacttcttcctaacagtcccaaatcttagcccatttcaatatcaactagtccaaatcacctctaaatatcatctgagtcaactgtgagggagataaagtgtgacttatacagaggcaaaatttttcttcatctgtgaggctgtgaaatcagacaagttatttgttttgaagtcacaatggtgggacaggcataggatggacattctgaatcagggagaaactggaaaggaggaatgagtcacgggtcccaagtaaggtgtaaccctagcaggacaaatattattaggttttaaggctttggattaatacctagtcctctcgacccaacagggttgcaactctaccccctcagccctgagtggaggtgtctggctctctgtaactgaggaggagacagccttacttccaggcctgtgccctctaccctctggttataatgccattcctgtcaactcctgaactaacttttgggtcattattcctttttcttacagaatatcttgtttatatccatgtagctctattggcccatcctgtggattctcagaagtctgacatccttccttcattttgtcccatctctgttcgaatcagttcaagctagcagcatttcctctggtataaaggtctcaaaaactttgtcccatgtgatccatgtgggtcaaagccaccagacaaaagaattctccacagatctttccttgataatcttatttttattactggcttctgctgagagggctgaatggatccataaaccacacacctgatctgtttagcaaatggttgtccagtgtggatattctccccagaataatgctttctcatttttttttgcagtatgtatagcctgaaaatttttctgtatcttcaagctctggttcctttttgcttaacaaatcctttttgaatttatctctctcctctcacattttcatattagagagaaatcaggctatggtttcaattctttggttagaaacttcctcaggtaaatatatccaattttgttgtttgcaagtcctatcttccacaaaacactagaataaaatttgaccaggtttttggctactttataacagtgattgtctttctccagtttttaataatatgtcccccgttgtcatctgaggcttgaccagaatcacttttaacacccatgttttcaccgacaattgctgcctgcaaacactgttttttggcatgcacctgaaatatctttcagctacctcccattaccgagttctaaagccacatccacatttataggtatttgttcctttggcaccccactcctggtaccaaagtctgaatttgtttgcttgggttgccataaagaaagtgtcatagactgggtggtataaataacagaaatctatttcctcaccattctggaggctagatggttgagatccaggtgtcagtacggttggctccttctgaggcctctctcctttgcttgtagacagccattttctctgtgtcttcactggtccttctctgtttgtgtcctaatctccttttcttataaggacagcatttatattggattagataccacccttgtgatcccatttagcattaatcacctctttaaaggccctatctcaaaaacagtcatattctgaaatagtggaagttaggacttcaacatttgacttctgtagaaacacaacccatagcagtctatggctatgtaattgggttaggccctgctctgctaacttgtgagccccctgcctggagtcaggaggcaagagagaatggtagattggaggttcagaggtgtggttcaaggccacatctggtgtctgtcatgatctaggtgatatgagtcagggtaatatgtgggaatgtggattcagtagggtcagtctagcagtatgttggatggaggtagcagggccttgtgtgggctgggatgttgtgcggtgcgccaggtatatctaggcatgggcactgctggatggaagccctgtctggtcaggctatctcttgtgtgagggatgacaacggggcagtggatgttgggacctgaaggtgtctgctgtgtcatcatagagagatgtccatcacattattgcatatgtgggttgcaagttggaggagcctgtcttgcttccccataatgaaagttcacaggtaggataagatgccctctgagaagagatccaggatggagcccatctcccacccaatctgcacctcacaggcagaatgcaggaagtcctcactgtcaaatgcactttggtccgcctcatcccaagtccctccagccttcctgcttctgttttcttcctggatgttcaggtgtgtccctcagatcctccagagggcttgatggcttctgtccatgtgacccttcctacctctgcctacccagttcactcaagatctgaagaccaacgaggcctcagaaggggccacagccacattgcagtgtgaactaagcaaggtgtcgctgtggagtggaagaagggacctgagaccctcagagatggggactgtgttctctgttcctgggccgtgtgctttctcaccatctgtatattcatttgcttattctgccatggtcctgtggtggtttgtgtgcctccttgtgtgtgtctgtgttctgtccacagagttgtccagttagtctgatgatctcagtgtctgcttggtcctttccagccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcaggggtaaagatcctgtgtggtcacatggacttgtggcttggaatctaagtgtctctgtgtcaccaccttctacttccaaatgtggcacccctgtgggaaccctgaggttgtgtgtcctctaactggggtcttctgggcatctcctgcctctgcttctcctcatcaggagatgtcctcctgttcatccccatccctgcgtgttctctgttcctcttgggccatgtgctttctcgccttccgtacattcatttgcttattctgccatggtcctttggtggtttgtgtggctcctcgtgtgtgtctgtgtcctgtccacagagttgtccagacagtctgatgatctcagtgactgcttggtccttcccagccctgccagccagattcatagacaacatgacaaaccaggaggccagagaaggggccacggccacactgcactgtgaactgagcaaggtggcccctgtggagtggaggaagggacctgaaaccctccgagatggggacagacacagcctgaggcaggatgggaccaggtgtgagctgcagattcgtggcctgtctgtggcagatgccggggagtactcgtgcgtgtgtgggcaggagaggacctcagccacactcacgatcaggggtaaagatcacatgtggccaagcaaagccatgttctggtgtgccagtattgatttcatgccatccgtctccactcattccgtgttgtctccctgtgtccatgtcatcctgttcccataattccccagaatcccttccagcctcccggactgttgcagaaaccaggagaaagcagcatctctagccagctcccacctgtgtatcagcatgggctcagtcacattgccctgttgggctctatgtcttgtcctccattccctcatattctgtctactgaagtgctccagatgatctgatttccatgtgtgtctggccctcttcagctctatatgtgccagattcatataaagactgaggtgtgaggaggccacagagggggccatggtcatgtgctgtacagcctggactgagggaagccacagtgcacagcctgtgctcagcacatcccgatgtggctcatgtccatttgggttctgtgtcttttctgtgtcatccatgtcctgtctcttctgtgggctcagaggcatgattgtgtccatatcttctgacctccccagccctgcccgccaagttcacaaagggtctgaggaatgaagaggccacagaaggggccacggctatgttgcagtgtgagctgagcaaggtggcccctgttgagtggaggaagggacctgaaaccctcagagatggggacagatacaacctgaggcaggatgggaccagatgtgagctgcagattcatggcctgtccgtggcagacactggggagtactcatgtgtatgtggtcaggagaagacgtcggccactctcactgtcaagggtaatgaccacacgtggccacatggactgatgtgggtgtgtgtccttcctctgtgtgcagttgcaggcaccgcacaccttctccttgtggatgctcctttcctcttcctcctgctgtttcctctgtcccctctgctcatgggttccagcgttatcctgtgccctggtgtctgtactgagcttcagccatgtgaccttgtgtaccagtcatggttgtagggaaggaattcccaccttgtttccctcccactgcctcccatcaccacctaatcaatccaactttctgccatccttcatttgagacctggagtcttttagccacagggtctcatgtccttctcggagggaggcctctggcgcccaggaaagggaggcaggacctagagccctgggccctgcaggctggccctggttctcagtgtagccttgtagggcaaacagcccctgtggcacttgagggtctaagggaacctggtccctgccctggagtctgggggacacggccctgtcctggggtctggaagacacggccccactctggagtctgaatacacatccctgccctgggatttgggtgcccacagaagggaggtggaacctatagccctgggccctggcctcgccctgggatctgggggactcagctctgctctcgggtcttgggtacagggcctcaccctgggttctgaagtacacatccctgccctgggctctggggtgtgtggccctttgggggctgggtggggggggccctgggtgagaggacagcctcctaagccctgggtagatgtagcccctccgtgctttcccaccacactgcctcctcactcctgaatcacagactggtggtccccagtaccatctgaggcagcactgcctgtggagccaggccagggagctgggaggagcccaggccctcatctgctggcctggagagtgatgcctggtatagatctggagctgaccctgccccctgccccctgcagccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacaggtgggctcccaggctagcgtggcccaggatatagcgcagttcttgtgctttgggcggaccctcggggctgccttcccacctggggctcccaactgagacggctccacagggtgggggtcctacctgccttgaggccctgcctccttcctcgtagctgctctgatgcggttccccctccccactctgccatgcattacacctgttagttcccccttgtagctcctcagggacctgccctcatgccctgctccctcccctgcagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcggagtggagcaggaggatgcgggtgactacacgtgtgacacgggccacacgcagagcatggccagcctctctgtccgtggtgagctgctcaccagcccctgcctcccacagcccctcattcttggtcagcggcaaggggcactaagcatcccttcctgcatactccgcagtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacaggtgagtggtggggcctcccagaggagagggtgagcctgccatcccactcccttatggttgccttctgggtgcacctgagtcccctgctctcatgctgtcttcctcctcacccctgcacctcccggtgtacctgtcagggctctctgagagaacctgggcagcaaggaaacaggctgcagcccctcaagcccacccctgaggccggtgtgtgggtgccctgctgagcccccacctgtttcttctgcaagccttgcctccctgctgtgctagccagggaggagctggctgcagtgtgggagtagacaggcagtcgagtgtcccacgaccccttcccattcctgagacacaactgccctcttggcccacacctccagcccagtttctgtccccaaagagctcagtgtcatggcgggatctgtgcttgtgagcacttcgggacaaaagccatgtgggacagatgggctatggcaaaagagtgtgagagtgcccaggaaggcttcctggaggagggggcgtgggatcttggcctgggttcttttacttggctggtaaagggaaccatctcgccccacccctcagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagaggtagccacaggcgggccccaccagtgactgcatggggtgagaatgtctgggccctgctggatacggagacatacggcaaaggttcctgcctttggaggctgggggcctggcagggaggtggacctgtgagctggcatttcagggcggccctaggatgtcagaggagagtgggctgagccaggctggtggggcaggttgtcttgggcttccagtaggctgacacagtgttggagtttgggtcttggcccttgcaggggggccacttcaaaccatagcccactcccagccctcagtcatctgcaccatctcctctagttctcacactagtcccatttacccacctgtcatccatcctttcgttcatctgtttatccattcacccatccatccacccattcactatccatccatccatcatccatccattatccatcgatccatccacaatccatctatttatccactgatcagccatccatccatccacccattatccatccattcattcttccattgatccattcacccatccactgtccattagagaagactctgcctgcaactggaatggggagctgagaacaggcccccatgtgcatgtctttgtgcactaggggaggatacccagggatggactcctgggacgatgagactgggttgattgagggggcacctcagacgctgaggctgacacccatgcctcccctgtgtccagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgaggcctctgggacctgagtgtaccaggatggggatgcttccaactccattcagaaaggccttccacaagggggttgtgctggggaggtgatgagctcctgtcattgaggtctggcaagctgactgggctccttctggtcgggatgggggctcccagggccaagcatgtctctccctgcttcctaggtgacccttgaggatgctggaactgtcagtttccacgtgggcacgtgtagctctgaggcccagctgaaagtcacaggtgggcagcccctttccacactggtcgctctgcctgcagatgcccagtttcctgggcaccagcacaacctacccagtggcagctgtcagcgggcagggggcagaaacccaagacttccaacagtgatcttgtcttggggctggcaattttccaacccctggccactgaagccatggaccagagaggtcactggggggtaggctggtagaagtagtcttgagaaattccagggtgtgtgtagggtccctgtccaggattaatgccacctgcgggagggagatggggggcccagctgccataggcttgggccctaaggtggaggcaggaccttcctgacttccaccctccaaacgcctactcctatgatatggatgcacgcacatgccaaagcatccatgtttatacacatctgcatgcctggacaggctcaaaggtgcagatgcaaaagcatgcctatgacaagtatatggatttgggcaaccatgcaaacaagattttaggaaccttcagcttggctcataccttgcccccagagctggtcatccctgagtgctagttcttgagtgctcttcccctactgtcctacctttaggtctcaaacgggtcccatctgtgtactcatcatccatctattcattcatccatttatccatttacctatccaccttccacccatctgctatccaccatccatccatccatccatccatcatctgtccattcatctatcatccatccttctatcgtctgtccatcaatccattcataatccatccattcatccatttatcatccatacagctaccatccatccattcaccatccaccatccatccattcaccatccactcatccaccatccatccatttactattcatctatccatcctgctgttcatccatatatccatccatcggcccattcacacattcaccatccatacatcatttatacatcatccactcatctattcattatccattcacacacccaccatccatccacccacccactgatccatccgctatccatccatttactatccatctatccatccactgtccattcacccatccttccattcatctaccatccacccatccatccatctaccatcatctacccttcccccatccactcatgtattcatcactcactcatccactattcacctatcttttcattcatccaccacctatccaccatctgtcatacattcacaatccacttgctatccattcattcactgtagaatataccctctaagctcctacccttaaccaagtcctgaacctcatgatgggccagatgcagtctgccttcagggggtctccaatctgttggaggagttggacatggagatagtgtgtccttcatcctagatgccacctcccactcccaagtccttaaaaggagacagatgcagtcagttctgttgcctgtgggtttgggaaaggttccagatgctagtgccctcaagttgagtgatgaagacgggaagtttcccaggtgtcctgagcaggggcaggatagcaggggcctggtgtattcatcagagtgggcaactgtatggagcagcatggagctgggctgtgctttggcccctctctaggtgaggtattctcagcctgggtgagctggctcatgtacagacacctggctatgaccttttggtgagggccctggcacaggtgtgtaaatgggtgcccatcccaggcccaggtaggtgttgtggtggaagagcttgggaacttgctggagacaagaatgaagagttggtggggcaagatgaggaggtggtcagatgtgcacttggggaagacagtcaagggaagattgggagctggtgctggggtgtcagtggtgcacacgaggaagcgcacggagaggcttccagtggagggcctgcttgggtgggcacaggggctgatttgcctggtgttgtcctgatgggtggctggtatctctgtaagttctccctactcacgcttcctcaccccataggatggaagtgtctgggctttgccaactgcagtttctctctctttgtgaggaggctcacaggatggtctcagaaagtttcttgggcaagcaaggatggagggcatctctgttgcccgatcccaggcagcaggtggtggaataagcctttggttctgtcttcctcccttgcctgtggggtgtggggttcaactctgtgggcagcagtagcctgggcacattctcctatctgccgtgaccaccctgagtttccatctgagaagtgggtgggagggaggaggagagtgtggaaggcacagggcaggcagtgaccacaaacatgtctgggaagctccttgagtttgggccctgctgtgtgaccaggcagggagcagttgccactcaacataagggccctggaattctgggctgaagggaccttggaggacatctggacagaatgccctcttgggatgggagaagcgtccgcttccacacccccagggacagggaactcactttctgaggtgaactcccatccactcacagtagcaggccctgtggcttctccttcccaacccacattgggtcagataaggcaccaaaggccagaaagaactccagccatggggcttagagcttgtccattctgccttctgagaagggcacgtgtgcctgtcatcagcctcctgtgggtgaaaccaggcatgttctgaaggggtgtgtgggggtgcgggtctatgagctggggctgagccactctccacaggctcactgtgggtggcctctgtgtctccctctgtgatcagggtgggccaacttgcctgggtggatttctattccctaaccctaggtcaccctcctggtctgggtgatgtctgctctggcagacccgagggtggcccctgtaccagttactagccccgaggctattctagcaagtcccacttttggtgggggtgaggggacagggtctcctgctgcctaggctggaatgcagtgatgtgaacataggtcagtgtagcctccaccccctgggctcaagcgatcctcccaccgcagctttgcaagtagctgggattacaggcacatgcctccacagggtctcactatgttgcccaggctggtcttgaactcctgggctcaaacagtcctcccaccttgacctcccaaagtgctgggattacagacatgagccatggtgcctggccaagtcccacttctgacaccaattctagagaacaacacactcactgtttttctcctattatactctcacagcacagaacactctgtgaccagatgtgtgggggccaaacaccaagcaattctctagcagacagcaactggctgtccacacttcaattcaattctgatactttctatgtggagttagagtcagatttcatagatgaagagctcagtcccacaagactgccccacttcagatgccagtgggaagtcccaagccacccacacttctgactgaacagctatgaaatggggttcccactacccctccttgagtttgattaacttgctaagacagctcccagaattcatagaaatacttgtattgagcagctgttataaaggatacagctcaggaatagccatgtggaaaagatttaaagggcaaaggatgggggtgggggtgggcatagaccttccatgtcctctctgggcgtgccatgctcccagcacttgcatatcttcaccaacctgggaactcatcaaatctcatttaagagcttttatagagcataatctctgttcccctctccccttcctagaggtgggagggtgggaaaattccaaccctctgaacacttggcctttctagaggcccattctgatgttgtccaggacccctacctgagtgacctcattagcataaactgagatgtagtcaaaggagtacattatgaacactcaggaatttctgagggctttaggagcagagacacaatctattcttgtgccacacccccacaccagtgaaccctaaagtagcccagtcctgtggactccagggtgtcccagcctcgccctccttcttaccctcttgtgcagaggcagtgccgtgcctggtacgtggcttgcagaatgtggatgtcttcgcgggggaggtggccacgttctcctgtgaggtgtctcacgcgggtgggccggaggcccgctggtggctggatgggaccctgctacaggatggcccccagagcgccatcgctgtgcgagatgggatctttcactccctcatgctctcgggcctgggggtggccgactccggcactgtcatcttccgcgcagggcccctggtctccacggccaagttgttgatcaaaggtattggccgatgggaacctctgccatgctggcacttttgtatgcttcctgcgggctcctgggatcaggaattggcccccagggccacagagtgggcaccactctatgcatgctgtctgcctgcagtggcacaggtgggcatggagggtggatgagaagtctgggcttagggagtggtatagctggacaccaacctgtgccctgctggctaccaccttgctggccgcacgtgcccagccatgaaacccagtcccttgtgaaggcaagagcagcccctgctgagcctacccctgctgtcacctgcttcctccgctgtgggctcaggctgggtttctgcccttctgggaaagagctggccgtatgggagccccctaccagtgactcacatggtgcctttgtcccctgtgcgccctcaaagaaaatgtggaaggttcacctgggtcctggggcaaacagccatttatggagtaggatttggacagtggagatgggacggggaccccaagagagatggcagagtccttgcagaaggggcgagctgggctggggctctggctcctgagccagggccagagggcatggggtagggggactttggagggtgtgtgtccctgttggggccatgtgcccagggctagagggaggtaggggcaaaggggaccaggaggggcccccctgaaaagagaccaagcctgacagtgctatctcccatgggtgggggtgaggtgtgtctgcagtggatagccctgggctgtcgtggtgggcccccttccctgggccatgtgccagatggtcactgctctgccattgcctgccacagctctgcgcttactgccgctgaagcctctaacactgacagcagagggtgggatggctgcggtggctcagctccgggggctgacatgtgtccggcatgttggccgacagatcccgtggtggaggtggtcagtgccatgcaggacttggccgtggaggagggtggctcggctgagctcctctgccagtattcacggcccgtgcaggccacgtggaagatggacgagcgggaggtgcacacggatgggcaccgtgtcatcatagagcaggactggaacgtggccaggctgaccttcaggccggccttgccctgtgacagtggcatctattcttgtgaggctgcgggcacccgcgtagtggccctgctgcaagtgcaaggtgaggccgcctggtgagcagccctaggcccggggcagctttggcacagcttgggctgtgcagtgatagtggaatggcaggcagtgtccggtggcgctgggacacaggtggctcggacaggtgggaacaggccccgtaggtggcaagctcgctgcaccaggagctgagctgtgagtaggcacggcatgcacagctgctgaacttgtggcttccatgaagaatgtgtggccaaattcaagactcctacacgtgaacccacaagagaatgagaaagggaggggagagcggagggcagtggattagggaggaggtctctggttgttgtgagtctgagcatggcattccagggaccaggcagcaggtctggtagctctgttggggggtgcagagaaagggggatgttcccagaccgtgaagctgcagcagggccatggcgggtaaagcatggctctgagcctcatggctgtgtttgagcctggttgtgcggttggcgagtttctagtcttgtgaacacctgtgaggtttctcacctgtgaggtcagaagcccagtgccaaagtgggcagggcatagtggtggtggtggggggtgctgggtgaccacagaggcaagcatgggtggctccaccctggacgctgagtgcccacctccacatagcttctggggagggggcattttgtttggctctttgtagttttcagggcactcccaagggacgtggggaccctggaagcgcgggcatggtctgatcctccctctccccacagccaagaacacggtggtgcgggggctggagaatgtggaggcgctggagggcggcgaggcgctgttcgagtgccagctgtcccagcccgaggtggccgcccacacctggctgctggacgacgaacccgtgcacacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggtgactgcgctgtgctggtgcagggtggggtcagatccttcccactagagactggggtaggcgggcggcagagggggcggggctgcgggctgcagctgcagaggggacgtcagtctccgagaccctcccgcaggaggctgggccgccggagctgcagaggggctgaggccctgggagcggcacaaggggcagggttcgccaggggccggcccatcccacctgaggccgggagccacccgcttcgcagtgggtagaagcccccggggccgaggcccaggaagggtggaacggtgtggggcgccgtgcgctgagaccagaggctctccggagccaggagggggacctgttggtctctgggacccacaggaggctgggttgaaggcaggcaggactgggggccagatgagaggtgtctctcgcaggaggctgggctgtcttctggagaggggcttgctggggccgcaggtggggagcttcggcctcccagacccctcccacccacgcaggtgggacgaagcgagggtatgaagcccaggccctccctgctccggcgcttgccctcacaacccttccttgggcacatctgcaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggtgggtggtgggcgagcttttccctcccctgcaggtcgggtctggggcgcgccccgcctccagagcttgcgagtgcgtgggtgaccatcctgggctgggttctgcagcatctgcccactccagagcctggggttgactgcctgcggatatgggcctgaccatgggagtctgggaggctgctcttggccaggcataaccatgcatgagcctaccaccctgtggattcctaaggccaaggtcccttcatcctgccccatctccccctcagctccccggactcctaatgcagatctgagcccagctctggggagacaggaggtacagagactgccaggggctctccatgctgggtgggctctgggcacatatagtctccatgtgacatgcacctgcagccagtatcagagcccagtggcttccagagggactgttggtgccgacagggagccacccccctgaccagtcccccttttccccaggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttggtgagttgcttcattggggtctggggagttcacagcccccacaagctggaggagggagggatccccgggagtggggcctgcaccctgggtgcatctttgctgatggggcctgtcctctgtccgtggacgctgttccccagcagagccaccgaagcctgtgcctccccagccctcagcccctgagagccggcaggtggcagctggtgaagatgtctctctggagcttgaggtggtggctgaggctggtgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccagggtgcgttgtccctgtccttccaggttccagggtggggagctctggtgtgggggtgcagcttggccttcctctcacaggctctctcagggaagggctgagggtccttttgaggaccccatcacatgggagagactgaggctccacagggagatgcggcaaaccccatgttgcagagccttgatggcgtaggccaacctgcctgtccctgagcaggtcctgggtggtgcagcccttggttctcctattctggtccctttaagcttctgggcccctgcacacagacatcccctgtactctgaaccccctgaaacccccggtgctctgatccctcccacactctgaggcctgttccctgaactctgagcctaatcctccctgcatggcagccagcacccccataagtctaggcgctctatcccagaagcagggccagaagggctcaaatcagcccaatttgcttttgcagagtcctttcctgttccggtcatcacataccctatgcagggaggtagactgaggcctcactcaaagtgggggagctgaggctcaggggctctgagacttgcaaagattgtgccatctgaagtagctagtgccaggtggggagagaggcctagcaaggccacagcccagctgcatactgataagcagctgaggtctggggtgatggctctgaactagcccactgactagtcttttgccttcctcagtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggtgagcccccccaacttggcctgcaaggagaggtctgagaccttcatcatctatccatccatccatccctccatccactattcatccatttgccattcatccacccatctgtgcatctactcatctatccatcttttcttccattcatccactcatctgccattcatccatctatccatgcatccattcgtccatctttcctttcttccttccatgtatccatccatgcatctttctgtccatccattcatccatacaccattcatctatccatccattcatgcatccatccaccattcatccacccatccatgcatccatccatccatccaccattcatccatccatccatgaatgcatctttctagccatcgttcatccatccatccaccattcatctatccatccatccatgcatccgtccaccattcatccatccatccatgcatccatccacctgccatccacccatccatgcatgcatccatccaccattcatccattcattcatgcatccatccatctaaaccactcatctacccatctatgcatccatccatccatccttccttccatccacccatccacccatccaccatccatccatctatgcatccatccatgcatgcatccacccatcctttaattcatccaactgccatccatctcttcaggcaaccgtttttccatccttccatccttctacctaatcaatccatttatacatctgtctttgcttactttcatctgtttatgcatcatccatctaccatccatccatccatccattcatccatccttctatccatccatacatgatccatccatcagtgcatgcatttattctcttctgtctgtccaccatccatccttcaatccatgcatctgtctattcttctatctatccatccatccatgtatccattcttcctttcattcgttcatccattcatgcattcattctttcttcttttcatccacccatttatttatgtgtccatctttgtttcctttcatctattcatctgccatctattcatccatatgttcatctttctttcctttcttccatctatccatctatccatccaccatctatccatccatgcacacattcctccttccatctagtcatccatccacccatctgccatctacatactcatccatctatcatctattcaccattctgccatctttccgtaattcttccatccatgcttgtatccattcatcatccatctaccatccttccatttgtccatgtatgcttccgtccgtccttgttttcatctattcacccatcctcctatctgacatgcatccatctacccactatccattcatgtatctactcaccatcctgttattcatccatctaccatccacccaccatccttccattccattccattcatccatccatctactatccatctgccactcctgcacctgttcacctgttcattcatttatctgtcagcctgtttacccacctatacaaccatacaactccatccatctgctgtttatcatccatccacctactcattcacccatccatccaccatttgtccatgatctattcctgtacttgctcacctgtttgtctgtttatctgtcagcctgtttccataccaccatctgtctaaccattcacttatccaccagtcacccacccactcactcatccatgcagccatccatacacctgttctcccattcaaccatccattcatcgatgtatctctccatccaccctgcatccatccattcatatacacatctgacagttaaaacttttgcctgaaaagttggaactggtctctttatggtgttcttcacaaccctgttcatcctggtctgagttactgtgtaaagcgatttccaggaagtgggcttgctttttggaaggtgctgtcagacatctaggtcagttgaagctagagtgggtccaattggtaggaggaaaaagggcatactggagcaagacctggagctgcccctgccatgtgcttgacacctgttgtgccctgttcctggcctcagattccctatctcaccatgacgtcaggctctgtgcccacaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctggaccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctggtgagtctgcacacagccttggtctggggtcacgagccagggtgcagaggcagggagaggcaggggagaaggatccaggctagtcgtagctagagtctgctgcaagctcaaggggttacctgtgcccaccactgggctcttcgcaggtgcagcccactgaggtgtgaaaagccctgactttgaggttaaatagagctgaatttgaactccaaccctgtctcttactagctatgtgctttgggggaagctgcttagcatctctgtacctcagctttcacatctgtgaaatgagaatgggaatgcagttgtaccttggtatacacagaggatggatttcagaaccctcatgtgtacccaaatccacacatactcaatccccaaatcagccctgcagaacctatatatatgaaaagtcagccctccctatacagggttttgcatcccacagatgctgtattctttgatccacatttggttgaaaaatatccacatataagtggacccatgcagttcaaatgcatgttgttcaaaggtcgtttgtattcactctctagaattttttaaaaatgagactctgaaatgtaacctgtataaaatgctgcactcctcatggtccagtctgcataccatttcccattccagcatctaggagtaattaaaaagccatttccttatttacttgtgtctctctaggaatgttaaagagggtatgatgaatgacccacagtgttacttcttgaaacttctctccaattttgagcctctcccttgcttcaaatccctcacctgctcctcctggacttacaggccacacagtctttatctttgctttacctcccttttcctccctgtttccagccctttatcccttttgcctcaaagtagcttgggaaccaagctggcaaacagaattcttagagaacaaggaagagagagaggcttagtaggcaaagataccattctgtttagctgtcagtgtctgtgaatgctcccatatgaatgattgttccgtacatcatatgtgtcaaaccattcatctggtggcaacttgcatgtatgtggcagccggacgtgatcattgttccctggggctaactcacccatctatcccagccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggactgtgagtactgcgtctggtttggtgtctccagggtgggtggtgtaggggctcctgagttggtcttgaggatagttcagagagcattcgtctcagcccaggcaggatttggggcctcactgtcttgtggctgatggaaagctgtctgggagctagggccaagacacgcccctagtctggagccccttggggtaaggggttgagggatctcatctctgtgagaggcatcctggctgggacagaggctcaggaagatttggaagtggacctcatggagtaaggtgagggggtcaagaagggtgagtccagcctaccccaaccactcccttgaggtcccttttgaaggctgtcagatggcttgatcaggaagcctctcaggagaagctcaagggcatggtgaatggtttgtggcactgtggcattatgagaaatatttatttgacctttgtcctcagttcctgacacagagcttctaaatcccttggaatttcctgggtgataggagcatcttttgttctaataaggtgactcttggtgggcccctagttaacttcaggatgaggggtggtttccagaaagaccaagcctttattagaagcccaaaactgtcagcactacctccatcctctcgggagggtggggatgctggagattaagtaatttatcatgcctatgtgatgcagcctccatacaaacccataaactaagatgtttgggcagcttgcgggctgttgaacacgtggaggtgccaggatagttgtgcaaagtgccgctcctctccctcacaccttgccctatgtatcttttccatgaggccattcctgagttatatcctttatagtaaaccattagtagtaagtaaagcacttttctgagttctgcgagccattgttgcaaattatcaaacacaaggaagagggttgtaggaacctccaatttacagccattcagtcaaaagtatgggtggaaatctgggacttacaactggcatctaaagtgagaacatacttgtgagattgattctgttaatgtttagggtctgtgctaactttgggcagttaatgtcagaattgaatggatgtgttgtacatccagttggcatcagatgtgttgtgagtgaaaacagctcagggacagactctggagccacagagttgggtaaaatcctggatctgctacttaccagctatgtgatctggtagaagtgactttatcactcaatgcctcagcctcctcatctggaaaatggagatcatggaaactgtcttgtggtatagctatgagagttaagtgagttgattcatgtaaaacatttagtagaacaggctgggtacatagttaagcacaaattgttagctggtttgcaaggcagttgttgggacaggagaaggatgctgtatctttcagcctgataaagtctcactgagtcctccagcctctggctggtacaggctgtgagatgctaaagaaagatttcttttctctttcctgccatccccttccatgttgagcctgatgccacaggccaggcagacagttttggaggtgctttggggctggatgggcagccatgggatggccctaagatagaactaataaatggtttcaagaagatcacaagatactagattgacatgcaaaaatcagtagtatttgtatatacttaaaatgaacacgtggaaaccaaaattaaaaacacaataatatttataatagcttaaaataaaaaaatttttttaacttagatgtaaatacaacaaaacatctactggatctgtgtcctgaaaattacaaaatgctgatgaaagacaacagaaaggacctaaacaagcagagagacataccatgttcatggattggaactcaacatagctaagatgccaaattgatatgtaggtttaatgcagttcctataaaaatcccaacaagatttttttatatacacagatgagcttgttctaaaatgtatatgggaaggcacagaacttaaaatagctaaaaaccattttgaaaaacaagaataaaatgggaaggaccattctacttaatgttaagatttactatttagcttaagtattaaagacagtgtggaatttgtagagggattgacacataaatcagtgggacaaaatggagaatacagatttagactcatacaaatatgtccaagtgatttttgacaaaagtgcaaaagcaattaaatggaggaaggatagaatttcaacaaatttggtgctggagaaatttggacatgcataggcaaaaaatgacccttaacctaaacttcacaccttatatgaaaattaactcaaaatcaattgcatccttaaatataaaacttttaggggaaaaaaatggcagagaatctttaggatcttaggctatgaaaagacttcttagacttgacagttaaagcaccatccataaaaggaaaaactggtaaactggatctcaccaaaattgaaaacttttgctctgagaaaaaccctgctgtgtagaggatgaaatgttacagattggaagaacatgttcacaaattatgtatcttgtaagggacttttatctaaataaatacaaagaatgctcaaaattaagcagtaaagaattttaaaaatccagttgtaacatgggcaaaagactatccagtcatttcatgggagaggatatgcagaaggtaaattagcatatgaaagatgttcaacatcattagccattagagatagtcaagttaaaaccccaatgagatatcactgcataactaccagaatggctaaaattaaaaatggtgatagcaccaaatgcaagtgaggatacagagaaactgggtcactcatacattgctggtgggaaagtaaaatgggccagccactctgaaaactgtggcagcctcttacaaaactaaccatgtgcttaccatataacccaacaatttctctctttttttggcatttatatcagagaaatgaaaaaattgcattcaaactaaaacctgcacccaaatgttcatagcacctttattcctaacagagccaagggctggtaacacccgaaatgtccttcaatgggtaaatggttaaacaaaccacctatgtacatctattctatggaatgctactcagccataaaaaggaactattgatgtataataactgtgataaaattgcatcttactacataaaattaaatatataaacatacactcaattgtgttcttgtaaaacttttgaaatctcaacaaaatcaatggattgcatcaatgtcagtcttctagttgtgatattgcactgtagttggtgagatgttgacattgcaggaaggtggataaagaataaatgggatctctatatcgcttcttagaaccgcgtgtgaatttacagttattccaaagtaaaaaggaaaaggaactattaaagaaaagtcaatgatcttaaataagaacttatatatttatccacatcattccatttctgagtgcatcattccattgtgtagatctagatttccatctgataccattttccttctgcctgaggacatcttttaatatttcttatagtgtgggtatgctggaattccttcagattttgtgtgtcagaaaatgtctctacttcacttttgtttttgaaagatgtttttcctaggacggtttttttctttccacattttaaagatgttgctccactgtcttctagcttgcattgtttccagtgagaattagaatgtcattcttgtcgttgattttctgtacataacttgtctttgtataaggatttaaaactttttacatatttgcacaccataaaattcatcatttaccaatgttcaatttagtgggttttagtatattcacaaggtctgtgcaaccatcacttctgtctaataatatgttctggaatatctgattctggaacattttcatcatgcctgaaaagaaaccattagcagttactccccattctcccattcccccagccccaggaaataactaatctactttctgtctctatgggataacctattctggacatttcctataaatagaatcctacaatacatggccatttctgtctgccttctttcactgagcatactgtttacaaagtccatccatgtagtggcatatattattatcgtacacattttttatggctgaaaaatattccatggtatgtggagtatttatgcatttatcaggtggcatttatccattggttgttttggctgttatgaacaatgctgcagtgaacatttgtatatgagtgtttgtgtgagcatgtttttaattctctcatgtatatacacctaggagtggaattccttggtcatgtggcaacttggttgaactcctagagggactaccaagcttttccacagtagccacatcattttacattcccatcagcaatgtacaagggtttcaatattgccacatccttgccagggcttgttattgttcatctttttgattatagccatcttaatggatatgaagtggtatctcattgtagttttgatttgcatttccctagtgactaacttttcatgtgctggttggtcatttgtatatctttggagaaatgtctattcaaattttttggacattttaaaattgggtaatttgtcttttatttttgagttgtaagagttcttcatatattcttgatactagagtcttatcagataaaagattttcaaatatgttctcattctgtgcgtgtctttttactttcttgagagtgttctttgaggcacaaaagtgttaaattttttttgagataaggtcttactctgttgcccaggctagagtgcaatagcatgatcctagctcactgtagtcttgaacttctgggctcaagtgatccccctgactcaccctcccaagtagctgggaccataggtgtgtgccattatgcccagctaattttttaatttttttttgtagaggcagggtcttgctatgtagcccaggctggagggcagtggtctaattatagctcactgtaacctcaaactcctggcctcaagtgatcctcctgcctcaacaaaggttttaaattttaataaagtacaatttatctacttgttctttggttgcttgtgctttagctgtcatttctaagaaactattgcctaatccagggttataaagagttacacctatgcctatagtaactcatatatttaagtgtttggtccattttgaggttttttttttttttttttttgtatatgatatgaagtaagggcccaagtttgttcttttaatgtggatacccagttgtctcagcaccatttgttgaaaagactatttccccattgaattgtcttggaattcttgtcaaaatttgattttctctaaatgtatgggtttatttatggactctaaattctgtttcattgatctaaatgtctttcattatgccagcaccacactgtcctgattgcagtagctctgtagtgggttttggaattgggagggtaagtcctccaacttccttctttttcaagattgttttgccttttctgggtgccttgcattttcataggaattttaggatcagcttatcactttcttcgcaaaaattctctaggtatttttaaagatttaaaaaaataactggttatgagtaatttgattatgattttctttggtgtacttttcttcatgtttgttgaggttggactttgttaaccctcttagaactgtgagtttagagttttcattaagtttggaatttctgtgaccattattgcttcaaatattcttttcttcaattacaggtatattaagccatattattattatcgcttcaaatattcttttcttcaattacctgtatattaagtcacatggagtgtatacagttcactaatgctcttttcacttttaaaaattcctgtgtctttcattttgcatagtttttattcatgcctttatgtctactatcttttcttctgtaatatctatcctatgaatctcattcattttattatttgtctctataagttctacttgagtcttttaaaatatattctacatctctacttaacgttttgaatgcagagaatacaattctaatacctgttttcatgtctcctctaccagttctaacatctgcatcagttccgggttggtttcagttgattattttctactttatgggtcatcttttcctgtctcttggtatgtctggtgatatttgattgagtgcctgacattgtaaactttaccctattaggatattttgtatttctgcatatcttcttgagctttgttctgggatacagtgaagatacttggatgcgattttattctttggggcctagcttttatgatttctttggtggctccagagcagtgctcagtctagggctaattatttcccactactgaggcaagaactttcctgagtattctactcaatgccctttgagttaggaatttttctagtctgactggtggaaccaggagctattcctggtactgtttcccctaatcctttcacgtgggtctttcctcacatgcagatactaatcagtattctgctgagtccttgaggcaggtcctttctctgtacagctttcttttctccagtactttgtctgtgaactctagctgccttagtctcccaggactctgagctccatcttcccatctcaaggagtctgctgggccctacctcagtttcccttccctgagcctacaaattcaaggcaggaaactggagcaatcatagggctcatgtttgtttcctgtgtttaagaaatcactgtcctggcctggtgcactttggctcatgactgtaatcccagcattttgggaggcttaggcaggaggatcacttgagcctggaagttcacgactagcctgggcaacacagtgagaccctgtctctacaaaaaaaaaaaatacaaaaaaattagccaggcatggtggtgtatatctgtagtcccagctacttgggaagctaaggcaagaggattgcttgagcctgggaggttgaggctgcagtgagctatgattgcaccgctgcactccagcctgggtgacagagtgagactctgtctcaaaaaaaaagaaaagtagagacatagaatatattttatttaatgtttttatctctcaatatttatttttcagttctttattttttccataagttattggggtacaggtggtatttggttacatgagtaagttctttagtggtgatttgtgagattttggtgcacccatcacctgaacagtatacactgcaccatatttttagtccctcgccgccactcccacgcttccccccaagtccccaaagtccactgaaacattctttttcttttttttttttttttgagatggagttttgctttgtcgcccaggctggagtgcagtggcgcgatctcgtctgactgcaagctccacctcctgggttcacgccattctcctgcctcagcctccagagtagctgggattacaggctccggcaaccacaccaggctaattttttgtatttttagtagagacgaggtttcaccgtggtctcgatctcctgaccttgtgatccacccacctcggcctcccaaagtgctgggattacaggcatgagccaccgtacccagtcagtccgttgtatcattcttatgcctttgcatcctcatagcttagttcccacatatcagggagaacatatgatgtttggttttccattgctgagttaccttacttagaatgatagtctccagtctcatccaggtcactgcaaatgctgttaatccattcctttttatggttgtatagtattccaccatatatatatatatatatatatatatatatatatatatatatatatataccacagtttatttgtccactcgttgattgacgggcatttggggttggttccatgattttgcagttgtgaactgtgctgctataaacatgcatatgcaagtgtctttttcaaataatgacttattttcctctgggtagatacccagtagtgagattgccagagcaaatgatagttctacctttagtcctttaaggaatctccacactgtaccacagtggctatactagtttacattcccaccagcagtgtagaagtgtttcctgatcactgcatccacaccaacatctgctgttttttaacttttttattatgaccatccttgcagaagttaggtggtatcacattgtggttttgatttgcatttccctgatgattagtgatgttgagacagaatatattttaaaaacccaagtagaacttccagagataaaaaaatccaattgataggattaatagcaagtacagaagaagattataaatttattacagaagaggccgggcgtggtggctcacgcctgtaatcccagcactttgggaggccgaggcgggtggatcaccaggtcaggagatcaagaccatcctggctaacacagtgaaagcccgtctctactaaatatacaaaaaaattagccgggcatggtggcaggcacctgtggtcccagcttgggaggctgaggcaggagaaaggcatgaacccacgaggtggagcttgcagtgagccgagattgtgccactgcactccagcctgggcgacagagcgagactccgtctcaaaaaaaaaaataaaataaaataaaataaaattgttacagaagaaaaaatacatcatgcaaggacatgatagaaagaggatgagggagctctctggggtcccatggaagttccaccctcatcacctaatacctcccaagggcccacctcttcatccatagggggttagtatttcagcatatggtctttggggggcatctcaacatttagtccataagagagggtaagtccagcctcagtcactccatcttgactagaaacactagtcctagcttctggttttgaggcctgtatcttttcatcccattattccctagtaggatggaactggaaggttctaccactatcactgtttcttctgaggcccctggatcattcggtattagtttgttgtgtcaaagaggcttgtagttagttataggccttgaagaatggggctagtaatagcctgaggtggagaggctacaatgttgctgtttcccctgtgacttcctagctcccaagtctaagtggctcccgggcaaggctctgtagtcaggacctctgagggccgaggccatcctggtgcggtagcttatgctggggcagatgggatggcagaccttgctccagctcccctcttccttccccagtgacaagcacagactatgacactgcagcagatgccacggagtcctcatcctacttcagtgcccaaggctacctgtccaggtaggggctgccagaggtgggctgtgccccatggactgacgtcgcagggcctctcggggagtgatgctgctgggtgagggcagggcttggtctgacagcatccaatcctggagccttcctccaggccctggcggtctctgtccactcagtcagcaaacaggggcttccagcgtcatccatgcccaagcccctcagcacccctcccgccctgctcccctcgatgccctgctttatggctgaccccttttctgttctgccagccgggagcaggagggaacagagtccaccactgatgagggccagctgccccaggtggtggaggagctgagagacctccaggtggcccctggcacacgcctggccaagttccagctcaaggtgaaaggtgagaaggagagggagtggggacacagccatggcaggatggaggccaaggagccataccccatcagccacaattgaaaggagaccccagcagcggggtcaggcagtcactcatccctgctgcctgggtgcaggaggctgacactctgtcactggtggtgtggggaccctctctccaggccttcatctgtctcccatctggagggcacagtgcccgtgggtggtagcccaggctgaccactcctcctcccgtggcccaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggtgggtgctctgaggggccgggcagagacttgggccctgggcagcatcctggccagggctgacatcccctgcacaccctgccatatcaggccctcagcgaggatcattggtcattgccccttggtacacagtggcacaggcggccggaagttggcccttccaggagtgggtgtgcagccctctgtcctgactgatgggcaggctggaggttgaagttgacccaggaaagtgggtcaacactgcggctctaggtagatccacgcacagccagagccggtggtagcttgggactagaggaccctacttccttattgttcaaaaagttctgatcactgagagttcattccaagtttcacccaaacccgtcctgccactgctgcagctttccccagcgtctccaggtgtgagtcctctgctgctctgggcagcattatttggttgtgtgctgattccagtgtggggccacagagtctgtggcagggcgagggtgggtggtgggtcatcgggtctggtccatgcggcctgttgcctctgtcacctgagtgtgtagagttccagggctccaaggcccaggtttcaggcaggggttagggcgtttgcttggggagcagcgctgcccttgggttccctcactgtagggggcagaactgccaggcacccgcacagcgccgggtaggagccacggtgggggcctgtgtgtgctgggtgtctgactctagtgcctctttcaggccctgatgagccagaagagaagcctgcatcaggtgaggcagccccagacaggcagggagaggccaggtggccatgggtgctgagggcctgagcctagggctggctgcagtggaggtgtgggtggccatgggctggctcagggagggcgcagcaaggagacagcccggccgagggggaagcgtggtgctgtccaggtgctggctgtggagagccacctgggcgtctgcagacatcatccggggccaggaggcgggcggtgggggctgtgccgaggtctctgccagccagcctgtgtcccctagatgtgcatgagcagctggtgccgccccgaatgctggagaggttcacccccaagaaagtgaagaaaggctccagcatcaccttctctgtgaaggtagaaggtaaggcgtttcctgcccgcagctatggaaagatcacccctgggggatgggacagaggtgccccctccccactcacatcatcccgagggaaggcctgtggcagggctttatctccagagaccccgctcctggcggggtgcacccaccacctcctgcctgcccctaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggccgtgagtgggggtggggggatggggggatggggggctggggcatggggggtgggcactgggtggctttggggtctccttggggcacactgcccatcaccaccatcttggctgggaccctgtgggaccccctccttcctcttttcattctctgacagcaccagggagaccccaaaatgggtcaggccctggtggtgctggtggttttgagcctcagagtcgcctctgggcccaggccccgtgggttctgcaccgctggctccagagacatttcctgaagccccctgcatcctgggccttgcttagcccctctgaggacaggaacccctgttctcctcccatcactgtcagggtgaccacgggccaagagtgggatggggaggtgagctcgggcacagcccctgctcagggcttcggagggacccagtccagatctggaatcagatgtgctggggttgggagcaccgtctgatggcttgccggtcctcctgacagtgcctaaggtggaggagcaggagaaagtgaaggaagcgctgatttccactttcctgcaggggtgagtgagggttgcccctccaggccagtccggtcagggccagggaggacgctctaggagtgggggacaggacagcgctgcccctggggagagcacctgtcccggagcgtgtcctggctctgccccatgcaggccatgtggtttgggccagctctcttccttctctgcatctcagtttccccattgtaaagtgagggcttctgttgggcctctctggtatggagcctctttctctggtatcttggtttgttgcccccagaccctctttttgtcaggagcttctgcataaggacagagggtggtggggtccagcccaggcctctcaggacacccccttcacctgtttaggaccacacaagccatctcagcacaggggttggaaactgcgagttttgctgaccttggtgggcagaggaaaggtacagtcagggtgggtgcatgcttgtgaggggccagggtggctgatcccctgatgcttgggggcagggaggaggctgcccaggggtggctcctggcctcagaggcccctcctgagcagcacagccttgggacacctgctcacacagccaggaccaacccatgttctcttaggcctggacttgaggcttggttagtgtcagaaccatgtctgatccccgtggatccgggagcctgtggggtccctgggccggccctgggcacagagctcacatccagcaggctgtgtagatacctgggtctgggtagaactcctaggtgctgggcactgagaacagaggcagcacagccccgctttggacccacggctcctcctgcagcctgatgcgcaggtctggcctctgctgactctgtccccagtgcccctcgtccactgtccactggcggcccctgctgtgccctctgtctctggacattctcagcccattggtcacgcctcggcttgacgctcatgagccagagtgactcctcatcctggccagttcccactggcctcctgccctgccggccactgagtctcatcatctccctgctggacatcagcactatgcgggggaggccttggctctttgttcaccatcggctcccagggcccaacatgggcctatggcatggggtgcctggtatacatccgaggggcacgcagccacctgagcagagcgtttgtatccgcagaagagcctctggctgccaaggaggccctcggccacctgtccctcgctgaggtgggcacagaggagttcctgcagaaactgacctcccagatcactgagatggtatcggccaagatcacgcagggtgaggggcagcagcccatgtgccagggtccctggggtgtgtctggggtgtttgcccttcccctgagccctggagagccagaggcaggccagggtgtcatgatccttgcacccccagccaagctgcaggtgcccggaggtgacagtgatgaggactccaagacaccatctgcatccccccgccatggccgatcacggccatcctccagcatccaggagtcttcctcagagtcagaggacggcgatgcccgaggcgaggtgggcggctggaaccctctgggagcagggcagggagaggccctgaccttcctgaagagaaggtgcagggtggagagggactcaggaggcaggacccccatgggactctagggaggtgggaccgcaccaaggtgcataggaggcaggaactggtgagaacagggtcttctcctcacggggcccggcagagacttgccttctgggagagccatttgtttgattcattcattcactcctttgttccttcaatggagaatgtgtctcaggcctcagtgtaccaggcaccctgttagggcttggggtgggtgtggagatggggagaaggtaaacaagtaactgagtgtaggcagtccaggcctggagaccctggggctgtggtgacctctaaggttgggggtggggcaggggaggtctcccacattcccgctgttctgcgtggagggggaactgggcgtgtgcacgctgactctggggatccctgccctgtggcttaggatctcggcaggcccggctggcacctcccgggtctcaccacttcagcacccccatccctctctcagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaaggtatctgaatggccaggcaggaggggtcctcaggggtcccggaggcccctagcagggtcgtcccaatttgaggggcgagagcccgatccccgcggggcagggccagagctcagtaccccaacagaaaactcctgtccctcaccagctgtcacctgagtggggggccgctgaggcccctgagttccctggggaggctgtgtctgaagacgaatacaaggcaaggctgaggtgagtgactgccgggccggaggtggtggcactggcatcccaccagctggacagtctcccaaagaagcaggccgcttgccctggctctgggtccaggacctaaccctggaggtcttggggtcatggccatgctgattcctctgcgggggcctctgaaacagcgctcctgtgtgagcctgttagggacgggtgggggccgaggacagcagagcaggcccagagctgcctgggttcccgcagctgccctcccagcctcgtgctggcaggacccatctgggtggcttcctgatgttggggccggccttgtccaagagggagcctctctccacctgctctcccacttcctgcgagcaggcaacaggctgcgcagcaggaggcgctcccatctagcagctgagggagtgggggcctcgtggcccacagtccctgcacgggaagcaggagctccgtggtcccttacggcagccccctcctgcccagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcaggtgggtgggtggggccacacacacacacacacacacacacacacacacacgtccatgcatggacacactgtagggccaggcctcctgcaggtgggttggagccaaggggggagagaacctgtgctgacttgatttatccctcagcacccctcccctcagaaacccagacatgtgtacctggcttactcatgggaaggcctgcggtgcaccaactgctaactggcatgtgcgcaggcccaagtgcatgcacaccctcacacgtgtgcacacatgaacacatacatgtgtacaggtgcagcctttaacagcatacacccatgtgcatggcacatgtgcacatctgtaaatgcacacacatgcacacagtacatacacccacatacacgtgcacatcacctatgtgcacacagtgcatgcctatagacgtgcacacgcatatatgcctgtgtacatgtatatatgttatacacatggacacacatatgtacatgcccccacactatctctgcacatctatgcatatgcacttctgcacacatgtgcacacccagcatgtacatgcacacccttttatctgcacactttaatacatgcacgcatgcgtatagcatacaacacctccttcctccaccacctgcctgtgtatgcaaccacatgtgtgctcatacacatttacatgcctccacaaatgtgcacgcccacatacatgtacatatgtaatattcatgtgagctttcatacacggcacacaagcacttatttgcatgcccacacatgtctgcacgcacactctcacagaccccaggagccacagggccccagcccttgtgcaggggccagcttcctcccagaggtgagggctcagggccaggctatggggcgcaggctgagtcctgatgccatcccccttcacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaaggtgcccatgcctgaactcatgggctcctgaacctcagtgcctgcccttggctccctttgaaggctcactgagcccaggcgtcctccaaggttcatcctgttctgcccacatcagagcctgcgctcatcttccccgacctcgccactgcccacagcctccctgcaccccccttgggcctcagttcagaaatgcgggtggagctgcttttgcagccctgtgcttctgggaaggccacttcagcagcccaagtcctgtgcttgtcacctgtcaggaggtgatgacagctgtcacctggggtgtaggctgtgtgtgcaccctggggacccaccctccagctctcagggacacagccatcagtgggccttgcactcctgccctaaaacccaccctcctggttcccacagaaatacgcggaggaggccctgttggcaggggacccctctcagcccccgccaccacctctgcagcactacctggagcagccagtggagcgggtgcagcgctaccaggccttgctgaaggtgggcaccacctcccctgccccgcctcctctgcccaggctgggtctcttgggttccagcctgtggagcattctaagccctgaccttcgccccggccccaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctgcaggccctgggcgagcccatccgccaggttggggagggccaggggccggggccgggagatgcatgtgatgtgggtgggtattggggtgctgggggcttgtatctggggctgccaggaggtggcggtgtgtgcatgagttgggcagagcactgggtacctgggtggctgtggggcctgcaccgctgggcaatctggcccaccacaggctgaccgcagcccacaccctcccccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcgtgagtgtccaccttcccgggggcccaggtggctgagccaggatggggcacccggctgcagccgcacaggtccctgcctgggtgggtgtgaggggtgggctcgttcctgggacagacggctacagcctcatggggagcccctgggctgggtgttgggttggccctgatccaaggtcggggataccatggggtccccaagctcaaggcacccatccggatcatgtcaggggctgtgaagggtctggcagcccggggtctgcttcctcaaccagaacagaatcttcccccgagcccccactgctctccatttaacatgcacctgcctcactcacctgactccaggtggggaccttggatgaggggtgacaagggacagtccccataggggccacaccatcagatgtggggctcatggtgcagggcaggtgacctgccaggtgcacctgggggtgccgcagcccgatgtccccccacagagcactcagggctgttgtgtgtcctcagggcccccggactttgaagaggagctggccgactgcacagccgagctgggtgagacagtcaagctggcctgccgcgtgacgggcacacccaagcctgtcatcagctggtacaaaggtaaaccccggggccaggggctgtggccttcctgtccaggatgcaggccctgcaacagaaaagagctgcccgagagaaacaggctgtgagggctggggacccaatatgggatttggctgggagtctggggcatggacaggccttatatgttcacttgccacccgccttccgaatcaaagacagcatggttggggacacggagatgccgaggcttggagaggagggagttcagtgggggcactcggctctgcaaagctgctagtcccatagtcagggctgattgtggccaaagggcccaggttaaattagctgccgggagagccacctagggaaaggtccaggcggcactatgcatgaacttccagttgtcccctcctggggggaatcatttctgccagtgacagcacgtgacgacatgcacgggatggtgccaaccaggtgcttccctggccatggtgtccagggttttgcaggctcagctgtggaatcctggctcactgctctgtggtgggccttgggctccagcccttctggaggccaagttgatgctgcgtggcccagggacccctaggaatctcagaaatctcacggtcagcatagatgatcccatgtggcccagggctcccaaggagaacagatgcttttaccagacaggatatcctaagagcctgagatcacctcccaggagctgggggcctctccctggggagcatcaatcctcccttgtgctggagccatgttgggtttcagcagcagagggacacagtttggctctgtcatctgtcaccttgtctgtaatgccaggaacctgctggggagggccaagaggggacctgggacaccagcctgggagccaccgtgctggagctggggacccaggctcaggggtggctgtggattccagggccgtgttgaaggctgaactggcccgatttgctgatggggtggctggctgtgtggaaagagcttggcatccagatgctcacacagttggggctggacatccaccagggtggttccttttacaaaggtggaaggctggggagaggcggggtgatgtgcagacagggctgggtgggaggaggaagcaccaggcctgggaggaccctgcagaatcgaggtgcctgcagggatgcaggcggaggcgctgaggggcggtcggagaaatacaagtagggctcaggagagggatgtggccggaaacgatgaatggaacgtcgtcagctcacggagcgtctgacctgccagtcgatgcagacgcagagtgcgtgtggaggggtgaggcccaagcacccaggcttgagagcccccacttccagagtctgcagagatgaggggacacgaacccaggggaaggagcggccagggaggtgggggcccaggaagccagccagggagaagccaacggggagtgggcagggggcgtccagggctgccagggtccccagaactgtggaatctcccattctacccctcacacatgtgcaagtcagcctgtcacggtttacacacatacacattacacacacttgtacgcacacgtacatagcgacacatagatacatgctacacactcatgcatatgtacatacacaccatatatatgcattacacgtgcatgtacattaacactatatgtgtaatatacatagatgcacgtcacacatacagatactacacatacatgcatagtatacaatacatatacacaaatacataccacacacatgaatatgtacatagatacacattatacaggtacacatatatgcacacatagcacatgcacatggatcatgcacaagtgcacactacatgcacctatacagctacatagatatatacacagatacatgcaaacatgcactatacacatacagagatgtatgcacattacacacacaagtacatactttacatatgcacacacactttatacacagctacacatgtgcatatatgcacacactgtacacatataaatatacatattagagaccacacatatgtgcacacatagataatactgcacacatatacatatgtacatagccacataccatacacaatacacatgcacagatacatgcaacacacatacatgctacacgcagacaccacacatgtatattcataaatactacacattcatgtgcatgcatacatacacagtacacatatatacacatagacccaccatatacataggtacacacagtcatatgtactacacacatatctgcatgtaaacatgcacaaatggtacatatacacatatatacatgtatagttacttgcacacacacacaagacacaagacctgttggtccaagacagaaatggttcatcactcaacatgaggcagcagccaggacaggctcttgccgcagctctcaggggtggtgtgggagaaacctgcacatgcatgcgctgcaccatggatttcaggggctgcatctcaccacctcgggtgtctccagggagggaggcatctctgctccactgtcctggaatgtctccttgtgtgagcgctgctgtctggagcatctgggctggccaactgtgggccattgtgccccaagagacccagctccaccctacttccacaggctccagcccctgggggattttcccacacttgtgcccagccctcagccatcctggctaatctgactgatgctggctggtatgccgtccttccggtgtgactcaggctgcatttactcaagcctctcagcaggggagatgccagcctgtgggactgccctggaccaccccaaggcaccagccaacatgtgtgtggctcccacacaggaagtcttgagaacacagttattgtttacaatttgggggctcctacgaaggcacacatcagtactgattgatggtacctcccagatgaccccccagggggtcacctgggctgtcaggtgaacctcatctggcctggctgaccggcctccaagcccccagttcagtccttataaccgagtgctgtcctggtgttgcaggcaccatctgggcactcagcccttcctgttctccctgtccatagcagccgggcccgcgggtctgcccatgactgaggacggggctggagaggaaggactccagggagttttgccggggtgtgtgggaggggccatcccagtgtccactggtcggagctgatgaacgcaatggcttggagggctgccctgggatacttctggaggaaggcttgggtgggtcattaacgcctgctccctggggtcttaggagctcccctcctgccacctgtccagacctctcctccgggaggttaggttcaagaggaacaaaagcttttttatcaaagcctgccagaagccagttgaatgccctgagccccgctccctttggaccaggctgccaccaaggggtggtcatggcagagcctgggtttccctgtggatggaggccctcccctgtcccttgcttcctaaccaccagcccagtaggcagcttgcaggagatagctcctctctggggacagctgcacttggtgaccggactgccttccaaaggtccgcaggccagtaggaggtgggcgcagtcagaccgccatccccttgctgagtggctcttgtggtagatgtcataggacatcaaactgcagggggtgtgtgtggcacacgtggctcatgttagccacacgctttcatggtgtggctggagacccaaagcagcctcacagcaggtggcctccacagagaccctggagagggacagctggcctaagggccatggagaacattcccctcggccctctgcaggttcactaaacaatcacttgcaaaaggcagacagataggaggaaaggcagacacacttattgaatgtgtagacactggatccttcagaatgaagacccaaagacccagaagaagctgtccattttaatgcttaggttccataaagtatggacaactgtgtggaaataggattgggcaaatagggttggatctagtgagaacagactgagtggggacaccccgctaggcctgtctgtctggattcttcttggccttctgagcagtgcccttttcttctgggtgagaagcaggacccttgctggaatgggggtcttggatccacagccaaacaaagtaggtcagatcatttcttcatggccaggttttacacagaacgatggagagaaaattggagtcctatttttaggctttctggctggctttagagaaaaaggtgtcctggtttctatgacccaccttggggaagagggattctgtttctatgtcagcctgggaggagaatgaggggctagagacaggaggggaggagaaggtcagagataaaattttgcttctgaggctgcttgggaagccctcattttggggtcttgttttctgagccccaacactgggttcataggagcggtatgccaggatggagagtgggttcaccatgtgtactgtgtcttcctttcctgtaggcttgagaatgtctctccaggatgtccccagtctgacatgtgatgtagatttctgcatctgtgccctgcctgtggtggggctcagcgatgtggtgtcctgggggctctgcacaggagccttggcggtctggccggggtgtccccatcagcagccttgattcacttcattgttcattgccccaggaagaggtgtctttaacttgccagcctatttaaaattatctctgatcctggcatggtgtcgcatgactgtgatcctggctgcttggcaggccgtagcgggaggagtccatgcactccctgccgtgtcccctctgccttcccttgggggagtttgttgtctcggggaaattgcttgagccaggaaaggatctgtggtatagaggggatggaaggggtcagaggacaatgacggaacaaggcacccctctgtggctcagccaaccatggaggtaggaccccgtctctaccgcaaacacagagatcctctactgtcacccccagaagaatggaaggccagcatggtggatgcaggaggctgctccacaagacgcccaagctgtggccgttcttccttagtgcaggctcggtgcccatcctctcccctccaaaccagccagacctagatgggctgagccctctcctgcctctgcccatcgtggctgctggtggccctccccaagcactcagttcaggcacgagtgtccgtggctgtggtctgaacagggttagaatcttcctcagatccagcgctggctctggcatttattgtgaaatggctgaactgaggctgaaccagcaaagtccctggcagggattggagaaagagtgccaaccaaggcactgcccaggtgtctgtgtttgaacccacttctcagtgctcagcatgcaactacctgcctagtttctctccttagcagggcaacaaagtagagaaagagatccacagggccgcttcttctttcccttccagaaggccatgcctctgacagtgtcacttccctgtccccaaaattgtaaaccaaaaactgtgaagggcccaaaattttaccccacttgcaatcttgcaagccagcctgccagccagatatagacaaaagacacaagactcatgggtcagagacaaagactttttaccagcagtgcctcagtgtctctcatcattgcccccacccgtttctgtgaggaggtgatggagctaggtgttagttgcatgcaggggttgtcccatgagagagaaaccgtgaatcttaggagacatggagctctttttatgcggctgctggtatatctgcccatgcttcactccagagatagggggtgacttcctaccctgggatgcagaaatgtctcccaggaaaggaatggaagggttttgtctctgttgtcctggaacacagccaggcagatgggcatcttctgcttcactctccttactttctactctactctcttcttcttcttctattctaaacctggctgtgagtgcctttgctcagagggctgaaatgtggaatctgaattccagggagaattgttttcccacagcaagatgaggacagagctgctggtagcgtggcggccctgacaggagctttgggggagagaactggggcccaggggatgggcttagtggggatgggaagagacgccttggagggtgtgagcacagctcctttctggagttgccataaaggggtgtggagatctgaggtggtaaccagaaggtttttgaaaaaaattatttaaaattatttctgagctgggtggggtggctcacacctatagtcccagctactcaggaggccaaggtgggaggatcacttgagcccagaagtttgagaccagcatgggcaacagagtgaggccctgtctctacagaaagttaaaaaattagccaggcatggtggtgcacctgaggcgggaggatcacttttgcccataaggtcgaggcagcagtgagctgtgatggccccactgcactccagcctgggcaacagagcaagactccgtctccacaaatatatatgtgtatatgtgtgtgtgtgtatgtgtgtgtataatgtatatatatcttatagttctatacaaatcataagtcggtgctggttgtgacctttgtgatttaagcaatctgtggggcacacccggcactattggaatgtgaatcgatgccgttttatgtatttagacattatgtgggaaggagttctccacagtgagaggccgtgccttcccatccctcacccgggaaggaagcattccttggccagaggtgtagtcggttgtgtgttcataccagggtgatttacttcacattcttcagtcttcagattttcgtattagaaagccgtgcgtttggaggcacgaggatgtggcctgggagaggagagtggagttgagggtgagactttgggctgctgtgtcctctgcaggggcaggtttagggagaggaggcatggagggctgtgggcagtgattttgagaaggggctgcaggccctaggctgggcaggcaggggtgaagaggggatcaaggtgctgtgagctggggtgcagtcagtgcattagaggtcctcagagtatcacaggactgctgagagctggggtgaccaaggactcagctgcccatagaggatgttctctgtggggctcaggtcccttggcctgccccctgcctctagctagtgtccaaagtggacagagaaagagacagacagtgagagacagagagacagagacagacacagagacagaaaggtgcaaaaggcacagacagaaaaacagacaaagacagagacatggagtcagagacagagatacaaaggcagagacaacaaggagacagaaagagagatagagacagaaaacagaaacagacacagagatagagacaaagaaagaaactgagtctaagacagagggacaaagaaagatggagatagagaggcagagacacagagagaaggtgagctcgtgtcagcctctccctccagggttgcaggtcagcctggaagctggacctggcagggagcctgtgcctggcccttgtgctacaagcgtggcccctccatcccctccccgaccataactgcagcccccaggccaggcccagcttctccccgctgatgaggtgagcccttgggtccccacctgggtgacggcccccgctcgtcctttccagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaaggttagcctgaaggccttcctgggggaggagccgccctgagcctcccaccatggcaggcccagctgcggcggggtggtgggacagtggggtggacacatctgaccatgttctgaggggatcattgggggatcatagagggcactgggaggggtggggatcctgcagccccttccctggcatcactctcagctccatcatggcatctctctgtctctctgtatgtctctgtgtctgatgcactgtatctatctctttctgtctttgtctctccttgtctgtatgtctctatctctgtctttgtcctttgatctctgtctctgtcaccctgtctctgtatgtctttttctgtctctgtccttctgtttctgtctgtccatctctatctgtgtgtctctctgtctttctgtttctctgtttctccatctctgtctgtctctgtttctttatctttgtctccgtgtctatgtctctgtctctttctgtctctatctctgtttcaatttctctttctctgtctctttctgtctctgtttttccatctctgtctctttgtctctctctatctctatttctctctgtctctatatttctctgtctctctgtctctgtatctttatctctgtctctctgtttctccatctctttctttctgtctctgtgtctctttctttgtaagtctttctgtctctatctctgtctctgtgtctgtctctgtctctctgtctctgtctctaatgtttctatctgtctctctctctgtctcttccctccacaaccccacagtcccaccacggttcgtgaacaaggtccgggcctcaccctttgtggagggagaggacgcccagttcacctgcaccatcgaaggcgccccgtacccgcagatcaggtggggcccaggcctgcccggggatggggcatgagggggtcggctcccacctggagcatggggcacgggccatgtgttcccgtgtcagggtgggctagacatggccactggccttcagctgagaatgggcttcgtggggctctggttcattctggatgtgcggcccccctcagccgggaggacacggccaggctctgtcttggcttctggaagggtgggctctctgaggacccctggggtctgagggcagggcaaccgggtcgtgagcacaggtagcacagctgggcgtggccctgagataggacataggaggatgtcgccggcggggtagagcatggcccaagtcctgcctcacgtgccctccgggtggattccaggtggtacaaggacggggccctgctgaccactggcaacaagttccagacactgagtgagcctcgcagcggcctgctagtgctggtgatccgggcggccagcaaggaggacctggggctctacgagtgtgaggtgaggagtgcaggagtggggaccggcctcgggacccaggccatccttgctggccatcctctggggtctgattgtggaggggcttaagagcccggtccctgtcctcaaggtagggggctctcggcagaggccaggggacaccatacccgctgctacacccttgatgacaggccagaggccaccatgccactgtcacccccccatcacaggccgggggccaccaggccactgtcaccccccatcacaggccgggggccaccatgccactgtcactgtcatccctggccacaccactgccccatgccctggcctcattcttcctctgcctctaagcctcttctctgctcccatgtcaatctggatgccttccttgacttccctggccatttcaaggatgccgcttggtttttgcctttgggggacccggctggcctcatgaattttgtcattcgtgtcaaatggagtgtcagtcatccagtgtagcccggccctgctcaggtaccttttacctgtggagacatccagcctacgggtggacagagctgccttctgctccagccactgtgtctgcagggccggggcaagggctcctcagggtggggcccaggcccagttccagtcctccggtccttcaaagcctgcagtgctcgtggtggtcgtggtggctgtgtgccaactacgggtgccccaggctccaggcgctagcttctgtccagttcctccaggggcacttgtccggccaccacctcccgccgtgtggctgctgctgtgagcctgtggggagcctgccccacaccactctggctggagaagccagagacccaagtgagctcttgatttgcactgtctgataccatcactagccacacacggggatttaaatttaaatttaagtcaactaaagttaaatccaaagctaggtgctgtggctcacgtcagtaatctcaacaatttgggaagccaaggcaggaaaatcacttgagcccaggagtttgagaccagcctgggcaacatattgaaaccctgactctgaaaaaaaaagaaaagctaaaaaattagccaggcacagtggtgcacacttgtgatcccagctactcgaaaggttgaggtgggaggatcccttgagcccaggaggtgaaggctgtagtgagctgagatcgtgccattgcactccagcctgggtcacagagcgagacccagctttaaaaaatacataaaatgaagttaagttcagttaaagattcagttccctggctgctctggccccatgtcccatgctcagagccgcacgtggacagggcagatggagagcatcctcatcactgcagggggccctaaggccgtgtgggtcccccagggatgctgtggcggggctggggcccttccccttgtgggagacacaccaggatgggggctgcccgtgctcccaacatggccacagggagagggccctacccgtggggagccttgggctctgagccggccctgccgtccttgcagctggtgaaccggctgggctccgcgcgggctagtgcggagctgcgcattcagagccccatgctgcaggcccaggagcagtgtcacagggagcagctcgtggctgcagtggaaggtaagtcccacccctgtcctcgccaccaaggcggctccccacggcccagacccaggctggaccctcacaggcctggccgtgtccaggaggacaagactctcacccttcccagtcagggtctgctgcctggaggaccctggaggaggggctgggctggcaccgtggggcagggagagccacagatggtagacggggaggctgctgtgggccaggcacaggtcccagccccctgctggaggcagcacctgtgtgggctggtggagggtagcccctgagcccagggcttggatggaggctggagaggtcactctgggtgggcggggttcccaaagccgctgcgttccggagaggggaagcctgtgcgcagaggccaggcctacacccagggcagctcgccggtggcagacaggaggcggtgggcctaaggcagtggggaggttgcagcaggaacaataggaaggacatctctgcagagggccaggccgctgggccccagcttggctcccaggagaaggagcaagtgtcaggggcctggcccctctattcagggtagggctggctgtggagatacctggcctggtttggggctgctcctggggtcctgggagggccttgggctgcagaatgacttcactagggatgaaaggtaaggggtggagggagaggtggggcacatcacctcatttctccaggctcccggatgctttgttcagggcaggggcagccaggatgggaagagggtcatcgggcatccgtcttgggctcccagttggagctgcccgtctggacaggttttgagccttccatccctggggacatgcaagtggaggctggcccaacacctggcagagctgcagctgccactgtgggagtggttggaatacatgtcctccaagtcttaaacattggctcctgcaaccccacctcaactgtctctcccagtgcccagtgtctgaaagccagttgcccatctggaccccacagagctgggccatctttgatgccctccatgaccctcagggagacccctcccctgctgggcagaggtccttgttcctcagcccacacggtgccactggcactggccaacctccgactgtgagtgccccatgtctgacgtgtctctgggggccctgagacctccgtcagccccacaactggtggccatagcaccacacagaactgcttctggagccgccagcacctcagcctcccatgagtcttgtgtctcatggccagctgggacacccagggctgcctcttgctggtgacaggagcgtcctccacagtcgttcacttggctgtcacaacaagtctttctctgggtctggaggagggggtggcaggggagagaggccaccagtgctggacagagtgtcagcgcctcagcaaggtgagaatgcaggtccttgaagagcctggagctggagccaacgcctccccgcttctaactcctatcctgctgcttcatctttaacccagcagctctgcagcccaaacaggccctggcaggcctctgcggggtgggcgctgccccctcacttgtgaatcatgctgcgcacggctgcatccctcctgtagtcgcaaatactcactctggcccacagccgatcaggtgacagtttaggtccatgaatgaaggtgccagagagtgtatgggcccagaggtgcctggctgtcagccccaagtgcagggaggatgagtggggaggccccgggttttcccatcactctgtgcagttcccatcactggcctgcaggtagtggacacattggctttctctggggtcagcttagtctaaacacacagagccttttggttggatctcattctctcctcacatgggctctcctctctccagggggagcctgtgaaatacacacctacacatatgtatacacgtgcatgcacacacgtatgcatgcacatacatctgtgcacatacacacacttgcacatgtgtgtgcacagaaatgcacagtactgtggctcccaagtgcacatatagacgcaggcagtccctgaaattcacgtgctcctcacctgagacaggtgtaaagcctttctccacatggcagtctagcaaagcagatggtgtcccaccccctgacccggagctgtgaggccatgtgccccaggccacgtcacttgacttctgggcctcctgctcgtttttttccctcagggtgctggggagggtcactgagatgtgaaggtgctggtggcccgtggactgcccgctggccagctggcttgggctgggagggggccatctttgtgccctgatgattctgcccgggagctgcaggggagagtccttgaggtgactgggaggaggagctgcctgatcccagatgcgtcccatccgatcactggaaccacaggccccatcctgctggctctggggagggaggcagctaggaaaacctggagagaccatggagtgtgtggactgaggatgctcctatagggagatttgggctgacgctcactcagagctcagcaccctgcccaggcatcccctggggctgttcttggtaggacttctgtggctttgcgccacaaagctcagttgtgccactttcaggactccagagtccctctctcctgaggattttttgtaacagagtccccagctgcctcagcctcagtgtggccgctggctccctgtgcagccacaggccatttattcccttctaggactcggtttctatgtctgagaagtgggattgtaggtctgacaaattcacggggctcccttggcacatgggttgaaggagaagctggaatttctgtgcagggagcgtaggtagggtcctcattctccccccagtccctgcaagaccctcgagagggacagtgggtcctgccttcacgaggggaagcattgtcctcagccctcattccgcagccactcaggacaggcatcgtcacctccatgtcagaggcccaggaactggggctctgagtagacaggctgcccaggggcagcttagcaggtgactacaacgctgtgccactccgatagctcagcccctagcactggctggtctgtaaccctcgctattccgactgttttctttgtagtcactgagcaagagactaaagtccccaagaaaaccgtcatcatgtaagtgcaggcgtgttcctaaccttccttctgactgcagtgcctcctgcatgccactgacctgcctggatcatgcctgtgtggcccagccacctgcttgctgcctgtctgctcacataacatgcaccctctgactgccagcaccttacaggtacttgcagttaccttgcataggcaccttcccctggggcctcgattacttccacacttcacagcgctctcttccagggcctcagtacactccgtggtcccactgtttcagcagagtagacttattccacacacttcacagtggttcatccaggggttcatcaggagctaggcctgagacctgctttcctcagtgggccagagacagaattctaatcctcagcaccctgggatttacgacagtgttgtccaacagaactttctgtggtaacagaaatgttctatatctgccaggcgcagtggcgcaggcctgtaataccagcactttgggaggccaaggcaggtagatcccctgaggtcaggagtttgagaccagcctggccaacatggtgaaaccccatctctactaaaaacacaaaaatcagccgggtgtggtggcgggcccctgtaatcccagccactcaggaggctgaggcaggagaattgcttgaacccgggaggcagaggttgcagtgagccaagatcgtgccactgcactccagcctgggtaatagagcaagctctgtcgcgaagaaaacaaaaagaaatgttctatatctcccctgtccaccacagtagccactagccacttgcgtctgttgaagcatccggaatgttgtccagtgtgattgaaggacaaattttaaattttaatttttgttcatttgaatttaatttacatagtgcattcatagtggacagcacagccttagggcccttagaggtccccaagcccgattttcacatttggaagatggggaaactgaagttcagggaagagaggaggttagctctgggtggctaatgactggaagccacttccccagtgccacacccactgtccttttcttcatccttcagtgcctcaaggatttaggaaaatcacacatgctgctgctgctgaggtaacacaagaggaccagaactgggtgaacccataaatgtagagttggttttgacctgaataatctgagaggacttccaatagaaggtgtgtgcaggcgggagtgatggaagagcttgcaaaagccaggaggcaggaaagactgtggtttcctaaggccagatggctgagaagctccaggatgggaaaactcttagttctcaaggggccttcagttggccgtattgtgggaaaatcccattgccagacatttgttgagatcctgggttaacccttccttggctttctccctcctcccctaaaacaagttgctcctatgatgccaccccacaatagatggggctgcctggatgctggtgagcaccccactcctggaggtatgcaacggtgccagagcctcacatagagtaggtctacattttgtccctttgggagcactattattatctacattttatggataagaaaatggaggagcagagatggagccagaatgccccactggcaaagcttcagaggcgactcacgcctagggaaaggaggaccaggtgatttacaagcatacaagtccagtctgttccaggcttaggaaggtggcaaccctcactctgcaaagcgtaatttacccactcagcttgaggattggagggagccaactgcataggcatagcgctgaacccaagggtggaccacacaggcagaggcactggggaggcagtaggcctgagaaggaaacagggcttggagacagaccccatatgctgtgcttgcagtctcagtacaggatgcccatgtgtccttgtgggggtggcagtgagtccagcatttgggggatatttaggagtccccatccacctgttgggctgcactcaacttaccaccctgcatcagcagatcaggcaacatgaggtgagcagatggggttaggcccaggctgtcagcaacaagcctactgccctagagcctgggtgtgaggcaggaaatcaggcctgtgggcacaagtgggccacatctctgagcctcagcttccccatcagttaagtggaatatatcactccctccttaatagctgagggctggaggaggcaggacctgtcattgctgtgcaccccaaggggtggtcacacatctctgggctcatgcctgggagcaactgcttccagatggagccctgagttagatgaaagcaaaactaaatgagagagagacagtactttggacaaagcagacagctggcagtagctcacttggtgacgactttgtcacctcatacatgccacatcccttgtcttgagcctgagggaagtgcaaggctgagggcaaaatgagtaacaggcagggaactggtatgtgttgtgtgttactcagcacgttctgcttccctacgtgttaactcagtttgctctcagtgctcagcaaggtcaggggcaccgggcaccagaggaggacctgggctgactgctctgcttctccctcttggccccaggcagattttcagcctctttgaccctctctgtcccctataaagtgggatcagaccctctcccaggttactgcagagtcagacaagagagcttgcaaagttcccagccagtgccccacgcacagccacgtacagccaaccttgcattctgcctccgtcactcctcccccatcccattttgggagatggagccaggcaggaggaggggcttgtctgatgtcacacggctcatcatggccaagccaagtctggggccacgtatcagccaggtttctcccttggcctgcctaaagcctttctgggcctcacactttcagacccaaaggccaggagaacaggtctgagctcagcccccaccccacccccacggcataagctgtccagcccgtccctggctgaggattttcagggtgtgcaggccctgccctctgagagttggccacgcaccatcccccgtgatacaaagcacaaaggtgggatggacctggaggggagacgggcaccggggccactgcaatcaggatgtgacccggtttttggaggcgcttgcctatgcagtgcggcacgggcctccccacgtacctcacctcttgttttcagatctgcacaccagagacagattggccacatgggaccttgtgctttgtttctttagttctgtggcagggggtgggggactctgtaggttgggctcacatgcatgtgtaagagttctttgtgcactctcactgctggcttgctggtacaataacctgagctctcacgctgccctggcaatcctgggcgctgtgcccatcttttctcgggccctctcctccctcccccagagaagagaccatcaccactgtggtgaagagcccacgtggccaacgacggtcccccagcaagtccccctcccgctcaccttcccgctgctctgccagcccgctgaggccaggcctactggcccccgacctgctgtacctgccaggtgctggccagccccgcaggccggaggcagaaccaggccagaagcccgtggtgcccacactgtatgtgacggaggccgaggcccactctccagctctgcccggactctcggggccccagcccaagtgggtggaggtggaggagaccattgaagtccgggtgaagaagatgggcccgcagggtgtgtctcccaccacagaggtgcccaggagctcatcggggcatctcttcacactgcccggtgcgacccccggaggggaccccaattccaacaactccaacaacaagctgctggcccaggaggcctgggcccagggcacagccatggtcggcgtcagagagccccttgtcttccgcgtggatgccagaggcagtgtggactgggctgcttctggcatgggcagcctggaggaggagggcaccatggaggaggcgggagaggaagagggggaagacggagacgcctttgtgacggaggagtcccaggacacacacagccttggggatcgtgaccccaagatcctcacgcacaacggccgcatgctgacactggctgacctggaagattacgtgcctggggaaggggagaccttccactgtggtggccctgggcctggcgcccctgatgaccctccctgcgaggtctcggtgatccagagagagatcggggagcccacggtggggcagcctgtgctgctcagcgtggggcatgcactgggtccccgaggccctctcggcctctttaggcctgagccccgtggggcgtcaccaccgggaccccaggtccgtagccttgagggcacctccttcctcttgcgggaggccccggctcggcctgtgggcagtgctccctggacgcagtctttctgcacccgcatccggcgttctgcggacagtggccagagcagcttcaccacagagctttccacccagaccgtcaacttcgggacagtgggggagacggtcacccttcacatctgcccagacagggatggggatgaggcggcacagccctgatgctgctgccatggtggcttggggcagcggggagaaaggagtgtccttgaggcctaggacgctgcccggcctcagcagcagccctgggagcctcctgagggccctccctgtccctggccacgggcccttcttacctcactcaacttcagccaggaggactgggtggtgcttgcaatgttggaatgaccggctcaaagacctcagctctgggctgtttcctgtcagcctggcaggagcctcaggactgtggacgaaggatgtggccttgggcatttgtcctgttcccacatgggcctggtccctccctcctggccccagccacagctgccaggcctgacatggccttgcctctcctgcagtcttggtgactgagacccttgggtggcgcttcccagctctgcaggccctcctggccttttctgcagggtggacacagggtctgtgtgtgggcagcagcccctgtctctcagcaagaataaagcagcttcctgtgcacctctctgattctccttgcctctccactgggcagccctgggtcccctctacctgcagccctcaggggagcccctaccctcatctgcccttgactgtgaggtcccctggctggccactgcctgtggagtcccggcccaccctggggtccctgagtggacctgcggcagctggttcccatcatggaggggccactcacaggggcacatggcatggccagaacagccaatcatgctccttcctggtatgcggggtgccaggcaggccttccccagccctgggcagctgggactgttgtcatggcagacgtggggatgtggtgaccccgtggggctcaggatctcagcatcaggggtcaacttcattgtctctggccggacgatcccagcaccattagcgtaaaacccgaagccctccagccccgaggctggctcaggggtcctgctgactgccttggagtgaggagggtggagaggagggtgccctggcagtgtagagagcagcccgggtgtcctctcctggctggcgactggggatgcagcaggggtcctcagcaagggcttgaagacacaagcaaggcgggagggttggggcaggtgacctgctggacccacgtgtgaggtgcctggctgatgaccaggtggacggggaggctgctgagggggagctgccagtggggaccacgcccagcagggctctgcaggagtctcttgcagccagcaaggggccaggtggggcggccggggccggggttgcaggtggagggtagggcagatttgggtcacaggtggaggagagaaagacgcccgacaggcgggtgcaggcaggggctgccctgggagggagggcccatccccggggaagggtccacagtcacggccgcctggacgcccacggaacccaagcttcctctggttctcaccttggcactaggctgtgcccaggtttgaggagaggccagccctggtggggggttgtgatcagtggcagagccagggcctggggtgggtatccaggcctggctgctccctggaggtggcgacactctcccgaaggttcccggggaggacgaggctgagctcgcggggggtctaggaggaggaagtgcctgcctgcagcatgggtctgtggttttttcctttctgtgtcccaggcctccacctccaggcagcctcctgagaggggagtgggtggggagcagcccagtgtcggcccacctgggcggtctctgaggagggggatggggttcctggagacccctccgcaggctgcagctatcccagacccctgggcctcaccccctctgcactcatttgccccttctacagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctggtgaggcccagatgcatgctgatgacaaagacccccagggattgaccccaaccctggctgtgcaacatgaggggtgcccatcccatgggcattaactggccaggccccagtgaccccgatttggaatcccagtggctccatgcactgggggtcctgggcaaagcctacctcttgcttggcctcagtttccccatctgaatctggcacagaatgggttctggaaggttcctcctgctctaaatctgttccaggagccagaggcttcccatgcttggcctgtgatggccaattcaggtgccctgtgctcctcagtggacagggaggagggggagcagggggtgagaaaggagaggaggagagagaggagaagagggagaggaggagaggggcagagggggaagaagacagaaaaggaggaggaggtggaggagggaggggcagaagcagccagtaccccagacagaccagaccaaactggctgctacaagagccagctctgtgggtcactcaagccctttcccccaggtgttatgatcacctaagccccttcccccaggtgttgggggtctcctgttatgaagcactttaacggcttttttgtctttggaacggggtctcactctgtcacctacgctggagtgcagtgtgcagggatacgaccacagctcactgcagcctcaacctcctgggtttaagcgattctctcacctcagcctcccaagtagctgggactacaggttcatggcaccatgcccggctagcttttttatttttgggtagagatggggtattgctgtgttgcccaggctgctctcaaactcctgggctcaagcctttttcctacctcagcttcccaaagtgctgggattacaggtgtgagcctggccaccaacctgctcgagccctggcctcgctccagcccagtcctcagctccctgatcaaggaccttttcctaaagggacagatggtgcatctggggaaactgaggcctgggttgggggaaatctcatcccaggccctgctgctcaccgcaggtggatgggggccctggagtcaggcgtccagaaagccatgaggacagggctggagcgaggccagagctagggcaggatggcagccagactcctcccctgccccgtccagcgtcctctgcatcctgcttgtgtaggcttctcgggtccatgcccttctccttctccttgtttggcccagaccctgccttggttatcttcacacaaaggaccatcacggccttgcgtcctgcgtgtctacccactctggtcaccccaccccatcttgcagggccttccctgatgcaccctccccagccacccctacctggtcccatcaccttggagaaaggccgtcaggctggagccaagcaggatgagacctccagggcacagccccccaccatggtctcacgcttaattccctaaacacatgctccaactggagtttccaacagtcccatagtccctgtgctgcttctgtggcctcccgcagggccagggggcatagggttcggggcaagcaggccaccttcccccatgagatgagagggccacccctcgggtctgctttcccacaacaggcacggaagcccccaggccttcaatgagctcaggctcctccctctagctgcctgggcaccctggggccacctagggccaaggggcgtccctctaggccccaccttggtgtacatttgctccgtgcacctatcacggggctggctgggtgcagggcctggcccaggagaaggggcacagcatccctgtcaccctgggaagtggtctcttctcattcttctggcctgtcacccttccccccgcagtgatcgagggctggtgtctgcaagggaaggacaggtcaaggttggggcgggggtctgggaggactggccctgaccctcactctcactctgcctcctgggtggagtgcaccccgccacatccaatggcctgtgtgccagggccacagtggctgagcagacaaacctgccccaggtgccgtttggcccatcctgggcagatcgcgggctccttcacaggcctgacgctcgttcactctgtccgatgcctctgcagagtgggcatgggttgtcctgctctggccatgaccccacccaccctgcctgtggcaggcatccgtcccactcgtccacctgcttgaagctcacgtgtacccgactcctacagccacctgccctgtctcccagcagccgtgcccccgagggtgccacagcccctcctccacgaaggcccagagcaggagccggaggccattgccagagcccaggaatggactgtgcccattcggtaacctccccagactgctgggtcctgcagtgggggccaacccccatgggacatcccagggcaggcagggcagggcacgagttaccgcggtggcctcacagccctcactccactccttgccagcagccaccccggacagggcagggcagggaggagaggccacccttgggatgagaggtgttggggggccccctccacactaagggttgggcccccatctgtacatctcatcccagagaggctttgctgcagcctcttccgagtagtggtgagcagggatcccctatctcactgggaggcctggctgctcagaacgtgtggcggcccggcagagcctcaccccacttcctaaccccaggatggagggtgcagcctggcccggggcaggcacaggggagctgctctgggacgtccacagccacgtggtcagagagaccacacagaggacctacacataccaggccatcgacacgcacaccgcacgtacggggttgggcccagctgggttataagcgtgatccccatgccccctgcccagggctggggggcatttgcacatctgcaaaggcctcccagcctgtcccagccctgccccagcctgggacccccacattctactcaccgtgtctcctcagaggggccagaaccctccactggggagaggcaagtggcggtgaacttggtgtccataggaccctgtccctgagagcgacagctgagttagtgagctccaccggccccaccaactccttctgatcacctggccagctgaggtcagagtgggagaggcagtggttccattgaaggagtactcctaactgtcagaagcctgggcggtcaggatggggtgctgtcgcttgggctgcggggggtgttcagttgcccacagtgtatctcagggtctcaccaaccatccaagcatggtaggctgtggctggcacccagggttgtgtggctggggaggtggtctccacagttccctccctgccctcccagggcccccatccatgcaggtaaccatcgaggatgtgcaggcacagacaggcggaacggcccaattcgaggctatcattgagggcgacccacagccctcggtgacctggtacaaggtaggcgcgcaggtccaagtgggtgagattctgggatggccccaggagctggggggcccacgggaggtgggtgcagtccacaccgtgcacttcccccacatcccccctagactggacacacagcaggtgtcggaagcactgctcagtgaagggtggggtgacggggtcccccagagtgggctgatagcagccctgccggtcctgtgcctccaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggtgagttggtctacccctcctgggccccaggctctgcagccgggctggctgggtacaggtcttggctccatggggcaacctctcttcccatggtggtacctgggtgggtgtggtacctgggtgagtgtggttccatagtcttgggtccatggagcagctcccgtcaacaccacagcattgggttccatggggatcagggtggtcacctttgcccataccagccgcttcccactccttaggggacaatgagccggactcagagaagcaaagccaccggaggaagctgcactccttctatgaggtcaaggaggagattggaaggtagcacccagccccctttcccctggactgccggatggctcctttccccaggccacctgggcttccctcactccctccttcctaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtatcctgccctcagcccctgagacggcttgaggaggggcaggcagggccaggccggggctcagaggagccatgtgcacggtgtcccctgcctggctgggtggtggcgacagccacccagccaggaatttgggtggggaggcttctgttccacggagcagtaactggagtccccaggggctactggtggctagctggccctgatgacctgatgccctcagcagggatggcgggggtcctctcccactctgtagatggcctcttagagagaaaggagctgcctggcccggctactctggggctcaccccgccacccacatggccttgtcttggggggtctcctctggtgctcttgacagggcgtcagctggacacatggccccctgcccaaagtcggtgtcctctttgcagggagagggtgctggatgggctctgtacagaggggacaggatgccccctcccaccgtgccactgcagtgagtggccttggtccccagggtcagcctgcagcccctccctctcctcagggctgggtgccatctggggttcagaggggtccccgctccaccctcctcaaccctgagcatcatcccctgctgcctccagagatcagatgtacccatagacctggctgcctcactgtgagtgtgggtttctggggacaggcaggtttcagcctcccaagcctgcttttccttgatgggatcccaggtgctcatccgaggagctgctggaccgcctgtacaggaagggcgtggtgacggaggccgaggtgactgggctgccgcccgccactgccccagccatgcaccctgccccagcccccgctcagacatccggtccctgcagatacagtcccagccacagccttctctagctcaggggcctctggggctccccagggcgtgttgacccctcattgggctctacacagcctgccaccccgcctcacctggccagctgaccagccctgcctgcccctcccccactgaggttcacaagtccattgtatcctccccacctttgagggatctcctggcttaggggcacacggggcccaggagcgctttgcatatcagctgccgaagccaggaggaggctgggcttaaagtggagagggaggctggggctgggctcccgcctgaatagcggcccttgccgcaggtcaaggtctacatccagcagctggtggaggggctgcactacctgcacagccatggcgttctccacctggacataaaggttcgcatgtcctcacccctgcaccccagagcctggggcctgcaggccaggtggggcaggcccaccactcccagtctgagaggacttgcttgcctccagggacagggagctcaccacctctaggcagccctttcaggtggggcgtggctctggtggagcagaggctgtccccaaatggctgcaccgggtgctccccactgtcccaccctgcccccgggcctctgggtgtccccaccaggcctatcagccccaggagtcacccccttagggcacggctctcacccactcccaactctccccaacagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttggtgagtgggtggctgggccaacgggtctgggtctgcaacttctccgggaagccagttcccacagatggctgggccctctcctctgccccggggaggcagcaggcagcctactggtcagccaaggggtcctccctgaacctgtctcctcctgcagccctgggctccccacttccctgtgtgtgtgcctcttacctgacagccaggcctggggtgacacacagtgtgcgcttttgtcttgcagggccatgggtgtcatctcctacctcaggtgagcagagccctgccccatcagctgcctcctccaaagctgacatgagacccctcccttgtaggcccaccgagggcatgtgcactgctggctgctccccatatcagaaacctgagacccaaggggctactatcttgggaacaggcggtcagccaaccctgataagaggttcctgcccggagtgtctcacaaacaccctgtcatcagagggctgtgctgggtcacgaggcagccaaaccactgccctgcaggactgggggttgtccagcagccgctcataacagccactgctgccctgaggatgatggtggtatggtatagactgagcctggacctcctcagcaggctgatccttaattcctaactcaggctgatcttgatccctgccccagactaagcctggatcccgatttcagactaaggctggtgccacccaggctgattctagatgcctgccccagcctgagcctggatccccatcttagactaaggctggagcctacccaggctgaccctacatccctgccccagcctgagtctggatccctacctcagactaaggctagtgcccacttaagctgaccctagatcccgtctgctacttgagcccagatactcaccccaggctcagtctgggtccctgttccaagctgagcctggatctcactggggaaatgagagaaacttgctgggatactcagagctagatgggagtgggactaagagcccatctgcggtcagggcctcatctgagggctggaccctccctctgtcttcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcagtgagtgcacccccaggcttctcctgcccggggccagtcagccctgccccgggggcagctgaccacctggcccctcctgagccttcctctccctgtagggcccggcctagtgcggcccagtgcctctcccacccctggttcctggtgagtatcagggtcagccccacactatgcagggggagcctgaggccaacaggggcagggcctctgggcaacagggcatgtgagcacagaactgtggctgtggcccgacctctgcccagcccagaggacgtttgtccctgtgcgttagtgagagggctgtgggaacctcaggctggaaccacatttcagtgccccagcccccaacccccagcaggaggcagggagaactgcaaggagctcagggacagggggtcgctgtcacctctgacctctggcctttgccatctgccccacctggacatcttgggtgagggctgtggtgtcctggatccagggaatcccagggctggggctgcccagaagggcttccatcatgggaggggcccctatcagggcaccatggtctccctgccatgtggctgcccacctcggtctcccagaaatccatgcctgcggaggaggcccacttcatcaacaccaagcagctcaagttcctcctggcccgaagtcgctggcaggtgagccgtgaccatctgagtagggaccagtgaaggggaaactgaggccccacggggccagctgcgcacccagaagtgcagggaagcggggctgggctcctttgagcatgctgaaaggaggcaggagtcatctgctgggcacagcggggttgggtgcacacaatcccatggggcaggagggtggaatgactgcaccctgggggcagaggaccccagagctcctgggtctccccacctgatgcctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtgaacccccaccccaccccaagcatcctgcatgtccaggggcccccattctgtacctaaggttactgcactccaggtgacggcaggaggctcccaggggccccccgctggtgtccaggtgctgcccacacctcctgtccctgcctcaggcctctgaatcttgggatcacctctacagccctgacaaccctccccacagggcagctgggacccagccctgggacctaacatagcggtggaggtctggggaggctgtaggtggtatgcccctggggaaagcatttgaaggggccagagtcttcctgaaccataatcctccctgaaccgagtcctcccgaacggccccaggccctccctgaccccagacaccccaacgctgcactctcccaaccccagatcctgcctgactgcagaccttcctaaccccagatcctcctgagtcctccttgaccccatagtcctctctgaccccagaccctaccttaccccagaccctccccaactccataccctacctgaccccagaccctcctgacctcaggccctccctgaccccaaaacccttccagacccccaaaccgttcacaaccccatagttctccccaaccacatagtcctccctggccctggaccctcctgaccccgtgcctggaggtggggagggtgcctggtcttcatgtttcctctgtcctctgtggcctggaagtctggggagtgggcagcgggccagccgaccccaatttcttcctgtcccagctgctcggggtccttgcagccagaggcagctggtactacccagaggggccaggcctcctgaccatgaccttcactggccctcttcctcctgcaggtctggagaaggaggggccccccaggaagaagccaggccttgcttccttccggctctcaggtctgaagagctgggaccgaggtgagcaggcccaacacagagaccaggccccactgcctctcagggtcccaccagcgtggccagaccggtggggagcaagcttgcactcacatgggtgcgggaacagatgaggggtcctggtgggtgtagtgaactgagcagtcttggaggacttcctggaggaggtgatggtggtacagatgggccaggctggggagttggcagtggtggggcagggctcctcctggtgtctccagggtccaggccatgctctggggcctggaggtcacccctgaaggctgacctcaccctccctcctcagcgccgacattcctaagggagctctcagatgagactgtggtcctgggccagtcagtgacactggcctgccaggtgtcagcccagccagctgcccaggccacctggagcaaaggtaagaagctgtcccaggggctgggggctgtgtgaaatcgggtgagtggccatcctgtgagctggccccacgggatgcctcgctgtctggaggaaaactgaggcccagggagaggtgtgaggcctggctgtggcatgaggcttgctctgtccttttgcagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcaggtacgtgggccacactgggggtcccaccaggccagggaggctgggctggggctgctgggaagcctcatcctgcgtggaatgcttccgggcccgtgcattggccgctgaggcatccgctccctgaccctgagcagcccacatccctatggggccaggcaccacacatggccagggctgcaggaggcctgagaaggtcaacacagagttctgaccgcccaggctgccttgggctggcaggaggccctgagctggtcccagcagaaacaaccagccttgggaaggatggccggacgcagctgctgacgttacagggcttggaaggaagcctgttcatccacgctccctgccagggagaaagcccatcccattggccacttgccgggagaactgagtttctcgggcgcatgacccattgcaccatcttcccacgttccttccatgcccatccctccagcctatgcaggagtgggctgcttcccgttccatgcctcaatcaaagtcgagttacaagcacaacacagttccctggggcgtgtttctgaggtggtcaggatgggggctacaggcctagctctgggacccctggcccaatgcccagagtgggccggcctgcttgaacctgtgcagggcaacccagtgaagcccagcagccccaccaagggcccttctgaccagaggctcggcccctgcacagggttctggtcacacccaggtggatgggccagcccaggagtgggatctggcagggcagacacctccccagcccctcgccaggagaggcccctcctaccattcctcactgtgactggaccctgaatgaacaggaccagggagggtgggctccagagccctggtggctgccagggtgaggcaggcgccagccagatattggcccctggaggctgggtgcccaccctggagtcactgaccattgggcagtgccttgcagagcgcccctcatcttcgccatgcccggatatcggggaggtgtacgcggatggggtgctgctggtctggaagcccgtggaatcctacggccctgtgacctacattgtgcagtgcagcctagaaggtatgaggtggcccctgtacccgaggctccggccacccctcccgggagccatgtctaggggcccttggggagatgcctggcctgctgtgttcccatgggtggcctcagggaagggtttctccacccccactgacgtggtgtgtggaggcctcagtggcccctcacgtgctcctgtgtggccaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctgggtgagccacaccacactcggggcttggagggtgggaacagcagctagaagacccagattacgctccctcctgtgcagggtctccatagctgtccacttccttctggggagacagctgctcctgggcttggcattcgaggcctacacactttaggggccgcctcacccccaggcccccccttcactcacctacactcccatgcactcattgacgagcacacaagtccattctgcttcattctgagtgttggtagtgagagttggtagtgactggcctgtgctgcctctagctttggtggaggaatgctagggttgattagtaatgtctgccctgggctcaagggaggaagagagggcatgattgctatgggtggtccattctcaaatgcccctgcagccctcacacacaccctcactcaggttgcctctcactgcttgctgtaccccctccctgtccccatacccccagaacctgaggaacaagaggtgggagtgcgtaactcaaagtcccagctgtcaaggtgcctgggaaggggtgatgggagacgtggggagagctggggctgtggggatgccctcttcaccccctcttatcatctgcccctcctcccacagcctctgaggaggagagccaggggcggtcagcccaacccctgcccagcacaaagaccttcgcattccagacacagatccagaggtgcagtggcctggggggctgcaggcgggtggggccagggcctggacccccccttgttgaccacccatgcccccacacccaccatctcgctgaactgggctcctgctgctctgagtgttgggaatcggggaatgggaggggaccacccaccagcctgaccgctgtccccttgagcaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagaggtgagggtggcctggggtggtgtggttgagctgatggacggactgatggactgatggacccaggcctctggggtggggctggaggaccaggcccctctgcacagccagtgcccctcccagtccacggggagtagtctcagccctggccctggtggcccccaccccggagcctgggctgagcagcttctgccccccagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatgggtgcgtgtgtggacagttggggggacctcacctggggcggggggcaggaagaagccccctctcctccagtgctgtcctctctcccagctccactgccacccactcagccacacacctggcccacacacctgtgccccacctatcccacctgggaccactcactcatgcccaccacctgtgtccctccacctgagcccaaccacatgtgcccctcccagctccagagctcctggagggccagggggctgttccacagacagacatctgggccatcggtgtgacagccttcatcatgtgagtcctccaacctgtctgggggttgctaggtgggcggggcagtctcccccctccacccgagggtgacctcagggcccctgcacccccgtccacctgagggtgacctcacggcccctgcaccctcgtccacccgaggatgacctcacggcccctgcaccggccacccgagggtgacctcagtgctcctgcatcccctccccctccgccctggtctacccaaggagggtgacctcagggcccgtgcacccgccacctgcgcaggctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggtaaggcgcgcccctctcctcctccttctccccgccccctcctcccgtcccgccccctcctccttccgtcccgccccgccccgcccccccactccctttcccctcggtactctcccttccccctctccccttttccacttgccttccccacacccctcccgccgctgggccacgtgctgagcctatgtccgtcccaggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 7 - DNA, 26107 bp, Homo sapiens
attcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcaggtgaggtctccgcggcccggcttcgcgccgtagggtcgccgcgctcctcgtcggccgggggcggggttggagaaggcgggcagagaggccggaaaacgcaggcgccagctcgcgcccaggtccgggccaggttcagctgggatgcgtgagccgatggaggctcccctggcatctgggagtgagtgtccagagaatagcttccctagttgacccacgagccatgtctgtgcccacgaatgtgggagcctgaggccatggggggtccccgagagagagagggtgtctgggcacttgcccatgaacggaccactgcatgcctgagagagaagggccctgacaccaggaacttgtgtggactcagggcgagtggccacctggaaggacacttctcagccagtgtgcccactgggagggggacagcgtgtcccttgctggctcgagtccacagggcaccagctgctttgggcacaggggagctggttctggggctgctctactccatgggggccatggtgaggatgagaccaggccaggttccttggttgggccctgggccctatgccaggttggctctgagttggatgcgcactgccagccaggatataaccaacaatgtccccagattcccgtgccacctggggccaggcaaaataggttaaaatccactggcagacccatttgtaagtgctccgagtgcaccgtcaaggtgggagcttgggaatgggcgacctcacctgccgcacctggacttgccagcacaggtctcttctcaccttgccagtctgcggcttccttccctcctgcgccccctggctacgcaggcctggaaacagctccttagggatcccagctgaacagctcctgggcttgggctatacctcccagtgggagggtctggcctggggtctgagggccaggggtggtgtggtgggcggggtgtgcctaacatccaagaatctactccaaataagggaaaatatgaaagagctggattttggcttcccaggactgcccgatctggtggctttgggatcgggcgacatctggcggttgatactatgttctagggacaagaaccctctacacgcccattccttgtttcctctaaatagggaaaagctagggctggaagacacggcacccacctcctgacactctttctgctggaattgaccactggtcactctgactcagtttccctgagctctgaagattaaggaatgaacccagacaacccagctcaatggcccttagtggagagagagtcaattattgatggaattccgtgcctgggaacttgctttccagtggggcagggggaccagaaggacaacttcaagcccgtcttgaatggggcccgtgcagggaggggtctgtatgggttcccccttcccagccctccctcccacctccaccccagctcccagacgcccaggcgcacttggtgcaggtgtgtctcaaagtggtcaggagaggggacaatatacaggggttggcctcagtactggaaaatgccatttgcaccccctaacaccactactagtgggaaaaaccagtggggccacaggctgccccgaagtgaatgtgctgggcggatcacagccccaccacgtgtcatgtagacacccagggctacaggagagtcaaccatatttgggcatgacgtgctggccaacccagggcctccatctctcactggtctttagcagataaattaattattactagaattgaacaggagggacagatacctgccttcctagaaaaaaaaaaaaaacactcagaggaggaaacattctggagaggggaggtaccgaggactgagagggaggggagtgcacaatggggaggaagccataggcaggctggcttctgactgaagatagtagcagtgagcgtccccagccgtcccctggtcccagtctacatctcggcacagcagccactgcaccatctccagagttatctaccagaaaattttgagtgaagagcccccacagctctggggacacaaccccccaggcccctgatccctgtcctcaggcctcctctgcacctgccaccacacctgaagcccacccagacccaggtgctcagagcctgacaagtcttatgggaacctctgagcaggcccctctgggtctggaatgccactcccgtgtttgccccctgccctggccacgctgggctgaggggactttccgacaggagaggaccccccgcttcagctccccccagtgccccgggtgaactggcatgaagggttaggcgggcacacgtctctgcatgcatcgcacggcgccctctgcccgcgcccactggcgtgcccgtgggcatgcccggaccccttcgaaggctgcttgctcctggagtgccggcggcctcctggcccagtgccccatatcctcccgggtggagggaagcagagagggaggcggtgggaagcagcgggcacaggtgcgcgggcgagggccctacggactgggaaggcgggcccgtggcagggggtctgcggggaccgcgtaggcgcaggccttgccctgcagccgcttcccaggtgatgagcacacaaagcgccctcggcagtgcctggtccggggctgccgctctccaggggttcgctcttagggttggccccttcccgccgctgccgggccggcggacggggatgccgccggggaaccctaggccctgggggcccggggaagggggatgacggcggggggtagggatgtgcagggacggggcagagcccaagtgacttagggaagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctgtttagagagggccctctggccttcagaggcccgttggttctgaagtgtgggttggagctcgtgcgtcccattgtctggggctctgggctctttgtgtccctggaggatgggtcgcccatcggagatggctccaaccaccagtttagatctacccccccacacacacacaggcaacctgggggccagaaagaagcatagttagcaaaactgcacccggggtgagttgggcgtggttgactgagagacctggcttgtagactacttggacgccaacttttctcttcatcttgggccaaactcttgcttccatgtaggccttgcttttctgcgtgtagcacgcaggagttggttggtagatgctccagcgtgcattgtgccagcccagtgtctgtgtcactggactggagaggctggcattgaccaggcctgctgcagcagcccaattcgttctcaagataggggctgcatgagagggcaggccccagaatgggtgactcgggggtgatgtggaacagggagaggagagggatgatgagtcttctcttcttcagaattgagaggccttccagttaccctgcagccctggaatggcccttgctgaacccaagaaagtgagggaccaagacttgggttcccccagccactcagagggcagatcccaagaaccaaagttctttctttggaatgccagttgaggcgaggggcaggcccacccccacaagtcccagcctcagtctagccaagctgagtcatctcagtcctggatggtagggggggcgaccggatgtggggaggcgggccacaccccagctctttagggggggtctcctccctcctcccagctcccctcctccttgtgagctggctggagcaggcctagttcccagagctttgccatataaggcaaaaaaatgttggaaagcagcagtgattaggggagggaggggttggctggcccaggggctggggaaaggggggtgggatggggcggggccatccagccagacagtctcccagccctgggccctggtccttccctctctcttttgggagggggatggggacggagtaggctggcctaacatggacctggtgggcctggttgctccccgtgtgggggtcgttgaggggtctgaggctggactggggtgggggcctgatgggaagccctggctggccttgttccctggccctgcacccttggtcctctccgagtccccctccctgctgccatttggggagagtgaaaggcagcctcgtggggccaggaccaacctgggaactggggaggccactctgagcggctcacctggccctccaggtgctgcctgctgggctgggaagcagctgccatggacagcccagcccctcctcataggcccgccccctagttgactcaccagagaagtattttgtctgattatgggggaggctgacagggcttctaaagatgagccatcctgccttgagcctgagacccagaagtagccttgggtggggcccagagcccagcagggttgccatggtgatggggggtgtcagggacccgccctaaccacttcccctgtggcgagcctgccgaggcccagaggcccgttaggtggcaagtgggtcaggcagtgggtggcaagggggttcccagtgtctcctgctgccaccccggcatctcccgatgggccccagtgagtcagggccatgtggcccaactgctggttcctttgggctctgggcccctcccctggctaggcctgtggcctcccaactccaagcttgagtcttcgaggtggtagaggaagtgggggtggtggcgggggtcacaatccctcacccaaagggcgtttgcccaactcccccacttcccctgcctcaccccacccaccctggaacaacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagccccaccaggggtgcacccgtgtgccaacgtcttccccataagacagtgtcccatctaaacgtggcggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggaggctggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggtaagttggaggctgcagcatgggcacctggggacagacgatggcaaggacggcccaccctgaggctccagggcactgaggggactggtggctgttgtcaggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtaaagagcaggctgtgatggcctaagtctcgccctgctgctcctgcttggggtctggtggggatggcactctgtgtccctggccaccctgcctgggttgtagctctggcagcctggacctggccccctgacagctgggtggtctcccgctaggtgaaggcacgtgggcctggattggagaagacaggtgtggccgtcaacaagccagcagagttcacagtggatgccaagcacggtggcaaggccccacttcgggtccaagtccaggtagagcacccacgggtgttgggggcagggcaggtgtgggcacccaggcctgggcactgaccagcaggccacctgctcctatctgcctgacaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgagccaacctccaccggcctttagtccatctcgatagcattcacgtagcacacgattcgtccatttcaagtggttgtggcacaccatcctgactcccctgtcccacagctcctggtgaccactaacctgctttctgctgtggctttgcctatcctggacatgttctatagatggaactgtgtgccatgtggccttttgtgtctggcttctttcgctcaccacgaagttttccgtgttttcgttcatgtttggcatgtcttggcactttgttcctttataattattttgtttatttatttatttatttgagatggagtctcacactgtcgcccaggctggagtgcaatggcgcgatctcggctcactgcaggctctttctcccaggttcacaccattgtcttgcctcagcctcccgggtagctgggactacaggcgcccgccacccccccggctaattttttgtatttttagtagagacaaggtttcactgtgttagccaggatggtgtcgatctcctgaccttgtgatctgcccacctcggcctcccaaagtgctgggatgacaggcatgagccaccgcgcccatcctggttttttttttttgagccggagttttgctcttattgccaggctggagtgcaatgacgtgatctcagctcactgcaacctctgcctgccagattcaagcaattctctcctgcctcagcctcctgagtagctgggattgcaggcatacgccaccattcccagctaattttgtatttttagtagagacggggtttctccatgttggtcagactggtctcaaccgcctgaccccaggtggtccgcccaccttggccttccaaagtgctgggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcaggtagccacaccctccactacagtcaccgagtccccagcctcctcatgcagcagcctaggggacagctccgagggactttctgcccactctcattccttacctgggagaggacaggcatggaggtccaggagggggttggggagcaattctggtgtctctaaatacccccttcccttctgcacccttcccagggtccagtaggcgtcaatgtcacttatggaggggatcccatccctaagagccctttctcagtggcagtatctccaagcctggacctcagcaagatcaaggtgtctggcctgggagagagtaagtagttggggcccttgtcgcaaaggcctttgtcacatccagggattggctgagctgggtgtcatgtctctctccttcctttcatcgtttccacagaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtaattggggtatgggaggccctaagggtagaacccactgtgctctctgagggccccaaaggtaccccatcttctccagacctgccctaaatccttttttttttttttttttcctgagacagactgtcaaccttgaccctgtttaagtgagagtaaaggggaggagggaaatagaaacccacaaaaagtcatcagggttgaagaatttcttttttttttttttctttctttttttttttttttttttttttttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggtaagggagcccccaggagcccgtgtggctggtgggcctgggaaccccaggaatgaccggctgtctgtttggaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggtgaggaggtggcggccagggcagggctgggactgtctgctcgtccccaccctgtctcatacagccgccatccctttgccccaaccctcaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggaggtaagaggcagggcctgctgcctgtggggagtggcccaggctggatgctgagaacctgtctgactgctcacaacaccaatccctcacagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggtgagctccgggcacaggcaggggaggcaggggggcctgggcggctggagtgtgggctgcgggtggctggtgtctgatctccctgcggagctgcaccaaggagggcagggaaggacagggcccctgtctttggtttgctaaggttgtgactaccttaggatggtggtgacaggcacaggcttccccagacgtgcacttgctgctaactttgagcacgtcaccaaagccttctgtgcctcagtttccccacctgtaatattctcatggggcaggtataggatagaagcttgagatcaccccggtgagctcctcctagtgctggccaggccctggggctgaggatgggtgccaagctggctggccgcgcctgttgtcatgtgggaagtgtgggatgttttagtctccattctggactctgccaggtgcaggcagcccttttgggccatagcagttaagatgcctgaggcccagagactgtccctgtagcagcagcgctgggcactctgggagcgcctgaggcaggcccggggctactcgggcttgggccaactgcctcccctgcctctgccacacaggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgagcccgcccgctgttggccgctgcggcgctcggcacggggcttgggttgtgcctgtgtgcaagggctcgctgcttggggcggcgtgtgggagtgggggccgcccccttgagtgactcacctgacctttctccttgctctctgccctctcacctcagtgtcaatcggaggtcacgggctaggtaagctgcttgctggggccactcccaatgcccctcctgcccagaggggcagcttcctttcctcttggggccgattcccaggacagttccagctgcagctctaggcagggacagagttgggtggggtgcagaagatgaggccgtgggctggagggcgagggcccagggaggcttccggagctgagcatgaccgctccagctcttcccctctctgggcctttatttccccatctgagaactcgggttgcagctgagagctttggggtgaggtgcatcctgagaggcaccccactggggactttggggtctcgggatcttggcacccagggaggcacaagggctcctgcgtgggctgagggaacaaggggtctccccaactcaatgggagccccagccctggccagatccacagacccccatccccaccttccaggggcctctgcgtcccgggccgggggaggtgcatgagcgggtggggctggctggtagtgcagtagcgccagtgtcgactgcttgggcggccagcatggcggggcccggcccagcctcagagccccaaagtgcattctgtggcccgtctccctccttcccccttcccctatcccccagcagtgacgttattcagacattccccaacaggcatggagggtcacctgccccagccagggacacccagggatgctgatgagaggctacaggcctggcacttgggcgaggtggctaaggaaagggtgagagggtggctagagttttgcggcaggagcgagatggctttatagagcaggccgtaggatccgatgtgtgtgtgacaggcgtgtgtgcgcagggcgggggaggctggggagtactgattgcagggccttgggggctttgagggtgggagcaagactcagtaacctcagtttccctggctactgtttgcagaatggagacagggagcccggggtggggaagggggcgctgaagttgctctctggcaagcttgacggccacggggcttcagtgagagccaaattaggaggcatactttgaggatggagtggctgagacctgcggttggctgggagccgggcagggaaagtgggggcagtcgggtacctgtgaggttggggcccaagccactaactagatggcatggggtgcacatgagtgaagcctcccagggcagcgtgggcagccggcagccaggtctggagcctgggagagctgcctggccgcggcaggccagcatggagcctagtgcagcaggagccctcggccgatagtgggacttggtggcagggcccctcgagcttggccttcaagtaggtttcgtgctcctggctgcttccctggcaggaggccaggctgcagggggcactctcactgccaggcctcacagcccacagccccccaagcctccacggcggagacccagatcataacgtcactgtctctcccctttcctcgggcactctggggccctggagcctgctcagctgctctgccctcgcaacccagcagtggtggctgtagcttgggcctcctgttccctgtctccctgggtgctatccccgctctgccaagcctgctgcgctgcgctactcgggtgctaaccccgctgcctcccgcttccccgctcccactcctgtctgcaccgggctgcttttcaccgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcacaggtgagtggggacttgggaaggagctcgggagccaaggaggccagactgtgccaatgagctgccctgacctcagccccactgccccacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggtgggcctgccctgcctctgcccactccaccgccaccacctcacagagagatggggctgggggacacacgaggctgccattccacaaggcccttcttcctgcctcaggaagccccttgcagttctatgtggattacgtcaactgtggccatgtcactgcctatgggcctggcctcacccatggagtagtgaacaagcctgccaccttcaccgtcaacaccaaggatgcaggagagggtgagcaatagctctggtcttgacctgctctgtgcccgggatgccctcaccggggtaagggctggactcaggagatactcctgaatggggctccctgccctgctgccctggccatcggagctcctcagtgcaggccaactggagtgtccccagcatagttcccatgctcacccacggctctctccagggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgggtggcactgggagcagtgacagaaacgggtggcagggtgggcatggtctcccatggctggacgcacactgatggctggcctgtccccaccaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgggtaagcggctgaagggtccagggggttcagaaaggaggcagcctgtggggagccatgccctccctgactgacagccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggtaggcagtggctgcccaccagctggggcgggagcactgtgcatagcaccgaggctcaggggtatccatcccctaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggtgagtgcagcagtgcctcggcagcccccctcactacaccagggcccacaggcagtatgtgactggaggggcgtgggccgtgctttcttcctgcaggcagccccttctctgtgaaggtgacaggcgagggccgggtgaaagagagcatcacccgcaggcgtcgggctccttcagtggccaacgttggtagtcattgtgacctcagcctgaaaatccctggtaggggctgtgggaagcctggggaggggtcctggggctcaagcagccccaagaggaggggtggagcccagggctgctgctcactagcccatccccaccctgcagaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccaggtaggcctgctcacaccccgagtgctcgctctcctgcgttggccagggtggggttgggggtggaggaaagagccggcaggcatgtctaccttggctatgcctggagggggccgaggctggtgaagcagccttcagtgaggacaaactgttctcccacagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtactgggaacccggctggggttggaggaggtggggcctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacaggtaagtctgtcggtgcggctgcacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccatt

SEQ ID NO: 8 - DNA, 3291 bp, Homo sapiens
tccagttaggagccttgatgccggaggggacagtggtaggtggggaggttgagtgcaaagggttcaggctgtaagtcatgttgggttggaatgggggcacaggaaggtggggctgttggggagccacgctaagccgggtgtctgtagcagagccagagaaccgggacactgaagagggtgctgaagggggcgactctcagggatcgagccagggcccccgaaggtgggatcgaccagggtaggagacaggaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccggtaaggccgcgggaccgacggggcggacgcgcccttgaccgaggtggcggggtggcgcgcgtgggagagccgaggccccacggctgggggccctgggttgccggggagctgcagggcgaggaagtggtcggctgggggcggcggggctgggcgggagcgggccggggttccggcggctgcacgtgggcgcgcacctcggtcgcccacgttcctcttcctcccccaacccagcctcgtccccggctcggagcagcggtgcttaggccggggccatcccctcctccattcccgggcaggccatggcctccgtcatctcccgtccttttctcagacagaaacggccccggggcgcggggcacggggcgcgccgagggccgaagggcggtgcggctggtcagagtgggccgccgcctgctgcctctaatcttatcggccgattagccgaagccacaaacccggtggcctcgatagcgggctcagagcagggacgccggctggcatgtgcgccgcgcggggcttcggaccaccgtctcggcttctcttcgctgcaccctttcacccttccccctatccagggcagtttcaccgaaaccccggcgccccgggcggatccttgagcggagagggcggggcgggagcaggaaggccgcgctgtcgggaggggcggggacctgcccgcttggcccaggtcttggacacctgggcgcccctggccctcggcagaacacggcgccggacagaagaggtccagcggttagtgggcgcggccggcggcacgaaggctggagccgcctgcatttccagcaatgacggcgccctttcccctcgcccgcagcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtgagcccccgggttctcccatctgggaggagcaaggctgggcaaggcgcccatttggggcctcactatactgaaaccctcattctgtctccaggtcttgccgccttggtagcttgctcctggtatggccatcagattgtcacagacttttataaccctttgatccctaccaacattaagtaagtctgggaaccctgcctcctaaggggacaggtctggggtcctggaatagggaggagggcagaggcacgccagggtttctaaccacccccttctcttcacaggtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggta

SEQ ID NO: 9 - DNA, 9802 bp, Homo sapiens
gggcggcggtcggctcctgctgcccctgtgccgagaccccgcgcacctggccaggtagggcccccctcccccggcccgagcggggcggggcgaggcggggggcgggcgccccttggcgcggtcccacttgggctacccttgcgcccacacctgggccggggccgcgcgacccagagaggggcggtgggagtggagcgcggccgcgtgcgcggggccggggtggcggggctgctcggacagggggcgccgctgtgcggatatggacgcgagcgcccccgcacgacgccggcccgaaaagagccgagggggaaggggcccgggatccgggtcgagcctgcccggccgtcccgactcgctcccgccctcgcggcctagctggagtctgggtgctgggcacggcctggacccttccctggggacatccgcccgggccgccgtggactggggtggccagggtgcggcctggatccccgcgtggcgagcagggcgagtgatgggagtgctgcccctcgcgcccacgttcctgggctggggtgggcggatagggcacccagcggccgcagccgcgagctcgtagggtgcactgaccccgttgggggctggggtgcccactccgcaagttatcactgagcgacttccggtctgtgagccccgtcctccgcaccccacctttccgccgcctagagcctccgcgccctcctgcgcccatcggaacttggcacaggttcaccccactttgtgtaggaactccagatccttccatggggtcctccttccagatactcaggaaccccacttcctgccagggtggagaggatggggtccttgaaggccagctgagggccctgacttcgagtcagaggtcaggggtcagcaagcagaagagtggattcgtgctgagtcattgcccatgggtgggttccgcgccctccctcccttgggcagacgtttggtaggcaaatgtgtgggcatgcaggccactggggtgctccatcttgggctcgggagtggctgcagccccgtccatagcccaggagacacgtacccatgaaaggagacgacgtgaggaatgaagcagttggaggtctgggcatcaccctgtgaggacgaggcatgtctgctgggagggctcctggccacgggggcttccactgtctggatggtccctgcccccattacacacagcctggagcctggacactgaaatccaaagggacagtgggggtcctttctagagtgtccccccagtgtcgggaagtaccctcaaacaacatcagcagggttgttccccctgccctgtatggtcagacaccgcccctacagacaggctggcaatggtgagtgggctcctcggcccagccagacaggcctacacctcacccccatgtggttggcctcgatctgcccctggcacaaccagagcggtgtgccctaaccagccccatatgtcaaccatgaggacggtgccccaacaaagaaatgttgggacagcttctcccaagccggttggcatctagggctgttgagtggcaccaggtatttcccatgtctcaactccatgtcacccccaggggcaccaggcaggacggctgcctcctgaccccaacattctcagccaagtggctccggctagcacccatgtagtccagctggccggcatccatcctgtcagcgcccaggggcacgctcctctgggcaccttcctagccagggccaacattcaggaacctgtgtgctaggcggggacaggtgtcctgcctccctccccaacccgaggagcagtgggatggactgagcagtccctagggctctccttccagggagaggtacccaggtagctcagtgaccctgtgtgcgtgggccctgggcgctccccatctgacacctttctggagaggccaggcccccgcagggaccctttggagaacagagtgggctgtggggcagccaagcatggatggtggtggcgagcccaggacctggaaaggtccctgctgccctggatgggggctggtggggacaggactctgagcaagtggagagccagatttgggcgatgtggagtgcaggccctgcagggccctgtgggcaccaaggggctgtggcccagggaggttttatctgagagggacagtgacaagaaagaggtcaaaggtaggccaagggaaggagggggtgctgggagacagggacggagtctagggatcagtgttccaggactgggcggtcatagaatgggctgtgggagcccaattgtgaaaccctgaggatggggaggaggtgtggcccgggactatgtgtggggcttaaggttgccattccaggaggagggtagtcacagccctgtttgctgcgctcaccttgggctaggcgtggtgtcatgtggaccctcagctgtgttgtgcagtagaggtaggccagagaggtgcagtgacctacccacagtctcccaggcagtcagagacggacacatgggcagcatgggcggcaccagcttgtccagtaggcacagtgccaggggtccgtgaatgtcttaaaataagaaaaaagtgaatattataatgatgaatgcagcctggattgtttgtctttaagccaacagtcatgaaatatttgggggggggggttcgttttatttttattttttgtagtgatgtggtctcactctgtcacccaggcaggagtgcagtgtcacaatcataattcacagcagcctccaactcctgggctcaaacaatccttctgtctcagcttcccaagtgcctgggactatgtgtgcacgccaccatgcctgcctaatgtttaaaattttttgtagagatggggtcttgctgtgttgcccaggctggtttcaaactcctggcttcaagcagtcctcctgcctcagcctcccagagaaaggagagacagggctgggatacctgtgccccagccctctgccagtgtcccctcagctaggggcatcctagggtctgggttgctctctgtgagcctggttcggctggtgccctggaaggcctcctgggcatgggctaaactccagcctacccaagtcactgacggccctttccacagtgtgtccatgctcgagggtaggagtggtcccagtgcccccacccctagtcatgtgtctccctgcccctccaggcccctggccccaacatggcccgtcgctctcagagctcctcgcagggggacaacccactggcacccgggtacctgccgcctcactacaaagagtactaccgcctggcggtggatgcactggccgagggtggctcggaggcctacagccgcttcctcgctaccgagggggcaccagacttcctgtgccctgaagagctggaacatgtgagccgacaccttcggcctccgcagtatgttacccgagagccacctgaaggcagccttctcgacgtggacatggatggctcctcgggtacatactggccagtgaactcagaccaggccgtgcctgagcttgatttgggctggcctctgaccttcggcttccagggcaccgaggtgaccaccttggtgcagccaccgccccccgacagccccagtatcaaggatgaggcccgcaggatgatccgttccgcccagcaggtgcgccatcttgggcttgagggtagtgggggaggggcctgggctagaggcacgggggtggaggagatgcatgagcatgatcagcttgaggggtgagcctgagctccagctggagtgggggtccctggcaaagatcttcagggctgccaggtctcggtcatcaggggctgcaggctctgcacaggtctgcttgcctgtggtcatggccagtgcccagaaactcgggggctctggggatgggtgggcaccccaccagcctgggttcattgttcagataattacctctcatcctgcccggtggcccttggccagctgagggcttctaaccatcaccaaacagctagcagacggcggaaggtgctgttaaaccatagcgactgaggcatgaggtccagacgctaaaggcttgtgactttctcccctgcccagggcaacaaccccgtcccagggcagaactggagcctggcacttggccctgacagctgccctggaatgggggcagctcagccgtctgtagggtggaggggattgaggggcccttgccgtgccccaacctggcccaccctcatccagggttctctgccctgcacctgcctcggtttcccccttatggccagccgttccacacctcttctgtttggtcccttcttcctgcccatcttcccagatgtggcgccaactccctaggatggactagcttgtttcacagtggtcgtgggtgatccagacacctcccgggtgtggaggggaggctggacaatggtgtggggacagcaggggcctctcctctccgtcctgacccgcccctgcaggtggtggccgtggtgatggacatgttcactgatgtggacctgctcagcgaagtgctggaggccgcggcccgtcgggtcccagtctacatcctgctggatgagatgaacgcgcagcacttcctggacatggccgacaagtgccgtgtcaacctgcaccacgtggatgtgagttcccgggagtgggagattggggaggacccgtgggagagatctgactcccctccctccccagttcctgcgcgtacggactgtggcgggccccacctactactgccgcactgggaagtccttcaagggccacgtcaaggagaagttcctgctggtggactgtgccgtggtgatgagtgggagctacaggtgcgcccgcggggctccctcacccccttctctggggcctcctcctgtaaccccagcaccccctttccacaccagggccctcctcgccaggagcccttgtcctgtagacccctgcacagcctagccgggcccaggtccttgcagacctcacatccctgcgtcctccgcgccccacccgctgcccacggggctgcagtgccctcgctccagctcggtttgactctggccctgacccccccacagcttcatgtggtcctttgagaagatccaccgcagcctggcgcacgtgttccaaggagagctggtctccagcttcgacgaggagttccgcatcctcttcgcgcagtccgagccgcttgtgccctcggccgcggccctggcccgcatggacgcctatgccctggctccgtatgccggggccgggcctctcgtgggcgtccctggggtcggggcgccaacccccttctccttccctaaacgagcgcacctcctgttcccgccaccccgggaagagggcctgggcttcccctccttcctcgacccggaccgccacttcctgtcggccttccgccgggaggagccgccgcggatgccggggggcgcgctggaaccgcacgcggggctgcggccgctctcgcggcgcctggaggccgaggccgggccggctggggagctcgcgggcgcgcggggcttcttccaggcgcggcacctggagatggacgccttcaagcggcacagcttcgcgaccgagggcgcgggcgccgtggagaacttcgcggccgcgcggcaggtgtcgcggcagacgttcctcagccacggcgacgacttccgcttccagaccagccacttccaccgtgaccagctctaccagcagcagtaccagtgggacccgcagctcacgccggcgcgcccgcaaggcctgttcgagaagcttcgcgggggccgcgcgggtttcgcggacccggatgacttcaccctgggcgccgggccccgcttcccggagctcggacccgacgggcaccagcggctggactacgtgccgtccagcgcgtcccgcgaggtgcgccacggctcggaccccgccttcgcgcccggaccccgcggcctggagcccagcggagccccgcgccccaacctgacccagcgcttcccatgccaggccgcggcgaggccgggcccagaccccgctcccgaggcggagccggagcgcaggggcgggcccgaggggcgggcagggctgcggcgctggcgtttggcctcctacttgagcggctgccacggcgaggatgggggcgacgacggcctaccggcgcccatggaagcggaggcttacgaagacgacgtgctggctcccgggggccgggcacctgccggcgacctgctcccctcggccttccgcgtcccagcagccttccccaccaaggtcccggtgccaggcccgggcagcggcggcaacggcccagagcgcgagggcccggaggagcctggcctggccaagcaggactcattccgctcgcgcctgaaccccctggtccagcgcagctccaggctgcgctcctcgctcatcttcagcacgtcacaggccgagggcgcggccggggctgcggcggccactgagaaggtgcagctgctgcacaaggagcagacggtcagcgagacgctggggcccggcggagaggccgtgcgctccgcggcttccaccaaggtggcggagctgctggagaagtacaagggcccagcccgtgatcccggcggcggcgcgggcgccatcaccgttgccagccacagcaaggccgtcgtgtcccaggcgtggcgggaagaggtggcggccccaggtgccgtggggggcgagcgccgcagcctcgagagctgcctgctggacctgcgcgactcctttgcacagcagctgcaccaggaggcggagcggcagccgggagccgcgtcgctcaccgcggcgcagctgctcgacacactgggccggagcggctccgaccgcctgccttcccgcttcctctctgcccagagccactcaacgtccccgcaagggctggacagccctctgccgctggaagggtccggagcgcaccaggtgctccataatgagtcaaaagggagccccacctcggcttaccctgagcggaaggggagccccacgcctgggttttccactcgaagaggaagtccaactacaggatttatcgagcagaaggggagccccacctcagcctaccccgagcgcaggggtagtccggtgccccccgtgccggagcgcaggagcagtccggtgccccccgtgccggagcgcaggggcagcctcacccttaccatctccggggagtccccgaaggccgggcccgcggaggaggggccgagcggccccatggaagtcctgcgcaaaggctccttgcgtcttaggcagctgctgagccccaagggcgagcggcgcatggaggatgagggtggcttcccagtgccgcaggagaacggccaacccgagagcccgcggcgtctgtcactgggccagggtgacagcacggaggctgccacagaagagcggggtccgcgggcgcgcctgtcctcagccacggccaacgccttgtacagcagcaaccttcgggatgacacgaaggccattctggagcagatcagtgcccacggccagaagcaccgtgcggtccctgccccgagccccggcccgacccacaacagccccgagctaggccgtccaccggctgctggcgtcctggccccagatatgtccgacaaggacaagtgttcagccatcttccgctcggacagcttggggacccagggccggctgagccgcacgctgccagccagcgcggaggagcgcgatcggctgctgcgccgcatggagagcatgcgcaaggagaagcgcgtgtacagccgcttcgaggtcttctgcaagaaagaggaggccagcagccctggggcaggggaaggccccgcggaggagggcaccagggacagcaaggtgggcaagttcgtgcccaagatcctgggcacgttcaaaagcaagaagtgagtcttctggcctggcaacccaggccagggtgcccgcatcgctgccccggtcatccagaagccccgcggaacagagagccctgctcatgtgcttgagcagcggctgtcaggccacggccgcttggggcttggctgagtgcgccagacctcggctccactggaggctcacctggcagctgccgtctctgccccctggcctccccaacgctggggctgcacccctcgccaccagtgcctttctcccctcagcaccttcatctctgcaccgtcagccttgcgtggcgcagcgtctggctccgccatctctttgtgcctcagtcccccccgccccctttatttttttgagacctagggctggagtgcagttgagcggtctgggctcactgcaacctctgcctcccgggttccagcgattctcctgcctcagcctcctgagtagctgggattacagatgtatgctaccacgcccaggtagtttttgtatttttagtagagacagggtttcactatgttggccaggctggtctccaactcctggcctcaaatgatcagcccgcttcagcctcccaaagtggggggattacaggcgtgagccttgcaccccgctaagtcccctatcctcttgcaagggtctcgcctctgtgcctcaattcctcattctctgggcccttctcctcctcagggcctcctgttctcagggcctcccccctccccgctccctccctctctcaaggtctcctccttccctcccccccccgtctcccccctcccccgcctgggcttcacttcctttcctacttggattctcctgctcgctgcctcccagcatcttttttggaggcccgtctcttgctgtggggaagactgggctggctgcgggcagtttgcaaggggtgggtggggcgggggggggagctggaccagaagatgccccttggagtggcaaggaagctggacagggcaggcctctggggacgggacacagggaagcccgaaggggcgccttggccaggtctgccatctcctccagcgaggctctggccagcactgggtgagagtggggagggggcactggcctttgcagcacagtaaaacatggtccagacaacctgtggccccggcctcatgagcaccccctgcacaggcccggcccaagccaggcgctagaagggctggttgtggagtgcttatccttgacaggtatggggccaggtgagggcaggggacaaggtgcagctgaggccgagcccaactaggtcctgggcacccctgcaggtgggagtggtccttgtcctcctggtatccagcagacacccccctctccccaccagccccattctcaggtcctttcctctttgtcaccaacaccaagaatctgtccagggttcttggcttatcttttatctcttttcactcctagagaggaattgcaattgactcagaatgacacattttggcaccacgtgtgtagaaagcccccactgttagatgatagcctcgtgaaattcatgtttctgtattctcctatttcttttcaaaaactaattttttttttagtgtaataaatcctaagagggaactgatttaagaaacaaggccgccaaacaaaggcagcagttccgactccagcagctgggaaaggaaggaaagtgaccccactttcactcctgcacagcccactggttaccaaaaccaccgtgcaagtcgggatgacagcagggacttctggccaggtgggaaaggtgcctggaagcgggatgcgcctgtgcgtctcttggccatgatgttcttgtgggcatgttattcttggtgctgcctggggtgttgctgagcggacaggctctccagctggagtccatggagaggccagaggctggcggccctgcctgggccttcggagcctcctgcctgcaccctccacctcttctaaaccatgatgtggcacattttggtgttaataaaacacaacacacaaagta

SEQ ID NO: 10 - DNA, 138867 bp, Homo sapiens
ggtggggaggtggcgcctgcgcagtgcgcctcggaggagctgtgtgtatgtgagagtctgacgggttcaaaatggcggcggctgcttcagcggctcctcctgtgtgagggaaacaacacccctccccggcagcggcggcggcggcggcggctctcggagcaccttcccagcggctgggcccgtggccgctctgtctttcctgggcaggggacgctccgggaggaggggcaacgccagggggcccatcccccggaatccctcttctgcgactggggagtagccggggggctcgtcccgcagcgcggagccagacctgagggggagacgcgaggggagccagggcccccatcccggcgcgccgcgccgctcccgccctgtccgccccccggggccggggcccgcgttccggggggccggggcggcgcggggagcctcgggccggccggtctcagctgatcggccgctgctcccgcaggcgaccagcccctgctggccgagggcacggcgaggagggcgctccctgcggccggggccggcccggggctcgggcccgggctgctgaccgctggcctgggggaggcgggggcgccccgggctcggcgccgaggggtcgcgctcctctctcctgacgcctccgactcccggtctccaaagccagaagagaaggtttgattcagcaactgtttgctcccttttcctggtcgctctgaccctctctggatactgggttgatccacggaaaaaccgaagacgacgtttgggatttaattattcctctcagctttggaatcttttacttctcacttggacaagaactcaagagcagaatctccggtgagtttccccctcccccccctcatttggaagtttggttgactgtgttatccaaagactgaatgcaaagtttctatctctttttccgatgggtgaaccattgaaacgccttttcctgggggagcccagcgagattcgccctttttcctctccggccctggctgctccatgcccaggcggtcgtcgcccagggggtgcaagcacggtttccctcccgacttcgggccagggcttcctccgggagggctctgcctctaactgctctgcaaactgtgtcatcgggtcctctggtctcgtagcagttttgaaaggatgctgttaacgtggctgtaatgtagtgacaaaaacggggggaacctgtgttctcaatggaagccattatccacgagaatatttagaaaaaagaaaaccctttcttggtattacggattgaccgtcgcgccggccggtcttttatttaatttttggacaagatgtattttccttgtatccttagatgcaatcgtttattttattactttatccaaaaagatcagatggaattttggtccttgatttgcacctctgaaatttgtttcagagttgtgcacatcttgtgttggggtggagggtagatttgggaatgataagatccggggagtctagaaaggaaggcgacgattgtgcacggccttacaggaggggtatgggaaattgttttggggtcatttaaatcctaattttttgtcctctttttacatagtcagtttgcccttctttcctttagtttctgattaccggtgagagagaactaatttggttaggatctggattagttcagtggtgcttcacctggtcagctctctggagataaaagtcctgggctttttttttttcttgctgatgctgccatgaaggagatccttgctagttgtaatcctgtggggagaaactggtggtgtggcccttccacaaggaactgaaaccaacatctcgtttcgtctaggcctccgacagttgtaatgtgattaatgttgaacatgacatggaaccacttgcccaagagcagaaaggtcccaaactcatgaagaggaacctgatttttcagagagcctttaacacttaccttaaatactcctttccgtgaacagaaagcacaagtttgagaatgagttctcatttctgcttatatcattattctttagtgttgcaatctggttcctaaggaggaagaggaaggcagccctggagtggtttctttacagtaatttcaacagaagagtgagagatggaacccgaagaagaaaggattcgttacagccagagattggttagtattttctccccccaccacaccctccagttttaaagtaggataactattttgtttccagttgtgaatatactgtgaatctgtgattaaaacttttcgggtgacttttctgtgcaccagaggagggggaaaggtgtattaatatcgaatttggcttttggccaaacatgttttatattttatatatttatcttgtttggaaatggagttatatgtagcctttagcttttatagaaaccattgtataccaaaggattttgtggattacaatgtgacaaagattcctgattttacagtactgacattgtaatacatctgattacgttagattagaatataaattttgggggcaaagctgtttgaggaaggatagttcaatacgttttttaagattttgttgtcccaggatttgtgactttgagcggggagaactatggattattttcttttattttataaattaacattttggtagctttgaagggttgttgggattgattgaagacaagtaggtagaatactggatgctgataaagttctgtgttttgggaggaatgtacgagatagatcttgttgaaagaaattttagacatgatttgaaaggattggcttatatctgtatatgaacacttggatcctttaagccatgctttcctcgtaaggtttccctattggagttttaagaattcaatttttgtttttcttagccaaagagagctttattagtagtctcacagtattaataaaaatctgaatttgtgtttgaagagtgggctatgaggaaagcgacagaattgtatgtagtatgtgaaatttgctgacctgaaaggcctagaagattactaaaggaatttatggtggttttatttggctctgcattttagactgaatttaggagaaaaagaatggttctcgaatacattttctagtgatccttactctttttgagaagagacttctttattatttatttatttttattgagattgagtctcactctgtcgcccacgcttggagtgcagtggcgtgatctgagctcaccgcagcctccacctcctgggttcaagtgatcctcctgcctcagccttgcaagtagctgggactgtaggcatgtgccaccacgtccagctaatttttgtatttttagtagagaacagggttttaccatgttggccaggatgatctcgatctgacctcatgatccacccaccttggcctcccaaagtgctgggattacagacgtgagccaccgcgcctggccatggcctattttttatttatttttatttatttatttatttatttatttatttatttatttatttattttttgagacagagtctggctctgttgcccaggctggagtgcagtggcgcaatctctgctcactgcacgctccgcctcctgggttcacaccattctcctgcctcagcctcccgagtagctgggactatcggcgcccaccactacgcccagctaattttttgtacttttagtagagacggggtttcactgtgttagccaggatggtctcgatctcctgaccttgtgatctgcccgcctcggccacccaaagtgctgggattacaggtgtgagccactgcatctggccttttatttttatttttatagacaggatcttgctctgcccagggtgacgttcagtgatgtgatcataactcactgtagcctcaaattcctgggctcaagcaatcttccattccagcctcctgagtagctgggactacaggcgtgtgccaccatgccagggtaattttcagacttttttttttcttagtgacggggtcttgctatgttgcccaccctagtcttgaactcctggcctcaagcgatcctcccaccttggcatcccaaagtgctgggattaacaagcgtgagccacagtacctggcttttttttttttttttttttttttttgtgactgctagaaaggtttggtgtgtattgggaagtatatattcagcatgcatatattccggtgagcctaatttcagagatttgtcttgttcccagttcatgtgttgagattataattctttatctctaactttgtagaaattaagcatatctgtagtagaatattgtatcgttgggatttatttttatttttacatttcttgaatttaacttttctttgggaacagaaaaagagatgatgccataaaactcctttcccaggtagttattgctatatggaattcacttttatcatgtcaagttgttagttaggtatctaaggaattttgcagtccagactttaaaggaagagcctttccagcaagcaaaacttttaactgttttttttttttgagacggagtttcactcttgtcacccaggctggtgtccaatggcactatctctgcttactgcaacctcttcctcctgggttcaagtgattctcttgtctcagcttcccgagtagctgagattacaggtgcctaccaccacacctggctgatttttgtatttttagtaaagactgagtttcaccttgttggccaggctggtctcgaactcctgacctcagatgatccgcctgtcttggcctcccaaagtgctgagattacaggcatgagccactggacctggacttttgggttttgttgttgttgtttgtttgttggtttgtttgttttgagactgagtctcgctctgttgcccaggctggagtgcaatggcactatcagggctcactgcaacctctggctcccgggttcaggtgattctcctgcctcagcttcctgagtagctgggactacaggtgcccaccaccacacccagctaatttttatatttttagtaaagatggagtttcaccatgttggccaggctggtcttgaactcctgacctcagatgatccacccacatcagcctctcaaagtgctgggattacaggtgtgagccaccgtgcccggcttcactttatttttatatatattttttgaaatggagactcactctgttacccagactggagtgcagtggcacgatcttggctcactgcaacctctgcctcccaggttcaaatgattctcctgcctcagcctcccaagtagctgcgattacaggcgcctgccaccatgcccggctaatttttttgtatttttagttgagacggggtttcgctatattggcaggctggtgtcgaactcctgacctcagatgatcacccacctcggcctcccaaagtgctgggattacaggtgcgagccactgtgcctggcccactttttttttttttttttttttttaaacaaggtagggaggaatagtgggaaggagagtcaagtactcttgacttttgtcttggcaagatttttttttttctttttttctttaagttgtaaggtgattggtacttgttgcatacattaacccttaactagcatatgttttcttttgtttaatgtgctatcttagcagtgtttgtgtaagaggacacatcatctatttggagagaactttctttttctttctttttttttttttgagacagagtcttgctctgtcgcccaggctggagtgcagtggctcgatcttggctcactgcaagctctacctcccgggttcacgccattctcctgcctcagactcccgagtagctagggctacaggcgcccgccgccacacccggctaatttttttttgtattttttagtagagatggggtttcaccatgttagccaggatggtctcgatctgctgacctcgtgatccgcctgcctcggcctcccaaagtgctgggattacaggcttgagccaccgcacccagcctggagggaactttcttttttttttttcttttttttttatttgagataggggtctttgtcgcccagtctagagtgcagtggcatgatcataggtcattgcagcctcgacatcctggtctcgagtgatcttcccacgtcagcttcccaggtagctaggactacagccctgtgccaccatgcctggttaatttttgtattttttgtagaggtggggttttgccgtgttcccaaggctagtcttgaactcctgggctcaaacgatctgcccgccttggcctcccaacaagtcattttttggggggaaaaaaaaatcagaaataactagttaaggactgggtgtggtggctcacacctgaaatcccatcactttgggaggcataggcaggaggatcacctgaggtcaagagtttgagaccagcctggccaacatggtgaaatcccatctctactaaaaatacaaaaattagctgggcactgggggtggtggtgcgtgcctgtaatcccagctacttgggaggctgaggcaggagaatcgcttgaacctgggaggtggaggttgcactaagcagagattgcgccactgcactccagcctgggcgacagagtgagactccatctcaaaaaaaaaaaaaaaattagccgggcgtggtgtagggcgcctgtaataccagctactcaggaggctgagtcaggagaatcacttgaaccgggaggcagaggttgcagtgagctgagattgcaccattgcactccagcatgggtgactgagcaaggcttcacctcaaaaaaaaaaaaaaaaaaaaaggccaggcacagtgtctcacgcctgtaatcccagcacttcgggaggctgaggcgggtggatcacctgaggtcgggagatcgagaccagcctgacacaacatggagaaaccccgtctttactgaaaatacaaaattagccgaacgtggtgacgcatgcctgtaatcccagctactcaggaggctgaggcaggagaatcgcttgaacccgcgagacagaggttgtgctgagctgagatcatgccgttgcactccagcctggggaacaagagcaaaactccgtctcaaaaaaaaaaaaaaaatggaataactagtttaaaaaaattgtcttttgccagttatggtgactcacacctatattcccagcacttcgggaggccagggagggaggatcacttgagcccaggagtttgagaccagtctgggcaacatagacccccgtttctcacacacagattgttttttggccgggtgcggttgcttatgcctgtgatcccagcactttgggaggctgaggcgggtggatcacctgaggtcagcagtttgagaccagcctgaccaacaaggtggaaccctgtctctactaaaaatacaaaaattagccggatgtggtggcaggcgcctgtagtcccagctactcaggaggctcagacaggagaattgcttgaactcgggaggtggaggttgcagtgagctgagatcacaccactgcactccagcctgggcgacagagcgagactccatttcaaaaaaaaaaaaaaaaaaagtattttttgccaagcttcattatttacctattacgtgtggaaaagaaatgcacctttgaagatggtgtgtatgtgtagatttggaatataagctacactttctggaacttggaaccagaatattctgcagtgttggagtggaacagctaggaaatgacaagggtggataaacaatgtttggcttctcttaagtaagacttaattttttttaggtaatgaaaatattagtacttttgtatattgattgccagaacaaagccagaactctgatgcaagtttgtatacctgagaaggtactcaagtgggagggatagaagcttccttttgatgctggggtgggttgttctgaggtaacaatgatttatttctgtatttctttttctttttggagacagggtctcactccgttgcccaggctagagtgcagtggtgtgatcattcctctttgtagcctcaaccgcctggctcaagtggtcctcccatctcagcatgtagctgggactacaggcatgcatgtgccaccatgcctggctaatttttaattttttctgtaaaggcaggctatccctgttcgggctgctcaggctggtctggttttttttgctcagtctggtcttgaactcccagactcaagcgatccaccttggcttcccaaagtgctgggagtacaggtgtgagccactatgcctggtgtgcttgtcaatcttgatgaaattgagagtttttagcactttcacctagcaaaaaaaaataaaaaataagaaattgagagcttttctaaaagatgttattatcgcatgttcaatcctgttaacctgtcttacatataattatgaaatagctaaatcatttatctgttacaaggaactgcggccactgaaactctggcaatagtcccacctttccttggtttacctttgaaagtgcctccccaaattcagcagcgattaccagattatcttttttaaattaattaatttatttatttatttattttgagatggagttttgctcttgttgccgaggctggagtgctatgacgcaatctgggctcaccgcaacctccctctcctgggttcaagcgattctcctgcttcagcctctgagtagctgggattacaggcatgcaccaccatgcccggctaattttgtatttttggtagagacggggtttcaccatgttagccaggctggtttcaaactcccgacctcaggcaggcgatctgcctgcctcggcttcccaaagtgctgggattacagttgtgagccagcacacccggccttttttttttttttttttttttttaggcggggtcttgctctgttgcccaggccggagtgcaatggcactaccactgcagcatcagcctccccaagtgatcctcttacctcagcctcctgagtggctggtaccacagatacatgccaccacacctggcttatttttaaattctttctagagacaggttttcactgtgttgtccaggctggtctcgaactcctgggcttaagtgatcctctctcctgcctggaggcctctccagcctccccagctcctgggattataagtgtgagccactgcgcctggacccgttcccactctgaggtctttctgactgagaatggactagataaaatagaatatttattttaagccttttttttttctagtatgaaagtataatgttagctagaaaaaattatatgtggtctacattgttgaattagtttatttctaattattttatgagatttagtctttagtctgtgttggtagagagtgcactggtctcattgttgcggcctccctcctaataatgtaggaaaaacttgaccatttttgggtgattcaaaaatgcagataatgacaactaattttttattcttatacatcagtcttccacagtaagctatattttgggcccctagaatgaggattaaatttaagccctattattttctgttgttttattttgctgagcattaatcactactgtactttgtgtatagctttccactagagtataagcttcttgagagttggggctttgtttttgtttatgctgtgtgctagatgcttcaaatagggcctaacacatagcaagtgctgaataagtatttgttgatattgttgaaagcctggatatatgctcttctttgctaccaattttcttgaatgctaggattaagccactagagtggaggagggtctggatgcagtggctctcacctgtggtcccagctacccaggaggttgaggcagaagtatcatttgagcccaggggcttaaggctgtgatgagctatgactgtgccagtgcactccagcttgggctacagagcaagaccctgtctctaaaaaaatgaataaattagaatggaggacactttggcaggtagggatgaggaggatatctggatattgggtcttgcagtgtagataagaaacagagacctaaactataacaaataaaaacgtatgtgtagcacacatgtcagactaccacattgatgatgtttggtatttggaccatttagaacaaataataaagtgtctagttgattttaaaagtttagtctgtctaggtacagtgacttaggcctgtaatcccagcactttgggagaccaaggccagtggaatgcttgacgtcaggagttgaagaccagcctgaccaacatggtgaaaccccgtctctactaaaaatacaaaaattagccgggcataggccgggcgcggtggctcacacctgtaatcccagcactttggaaggccgaggcgggcggatcacaaggtcaggagatcgagaccatcctggctaacacggtgaaaccccgtctctactaaaaatacaaaaaattagccgggcgtgatggtgggcgcctgtagtcccagctacttaggaggctgaggcaggagaatggtgtgaacccgggaggcggagcttgcagtgagcccagatcacgccactgcactccagtctgggtgacagagcgagactccatctcaaaaaaaaaaaaaaaaagaaaaagaaaaatagccgggcatagtggcacatgcctgtaatcccagctacccaggaggctgagacaggagaatcgcttcaactcgggaggcagaggttgctgtacgccgagatcgtgccactgcactccagcctgggcgacagagactctgtctcaaaaaaaaaaattaaaaaaattaaagtttagtctgaattttaagctctcctattctttttttttttttcttttgtgagacagtttcactgtggtcactcaggctggagtgcaatggtgcgatctctgctcactgcaacctccgcctcccgggttcaagtgattcttcagcctcagcctccctagtagctgggattacaggcgtccgccaccccacctggctaatttttttttttttcttgcaccaaagctttctaaagttagtgatttatttctgacaagtttgcaaaacccaagagagagcagttttctgggttgaactcatacttcgtgtttactcgagtctgagtcacggcacctgacttcctcacaggtgcacctgactgctctttaccacctggctaatttttatattgttttagtagagacagggtttcaccatgttggtcaggctggtctcaaactcctcacctccagtgatccgcccacttcggcctcccaaagtgttgggattacaggcgtgagccaccatgcccggccttaagctctcctgttctaatcctgtcctaaactgtgcctaggttttgctgacctttagacagccttaaagctgtgaagttgcaagtgatgatgtttgtgttattctcgggtcttggttttggttattaagtcaaggaattgatacattatgtatatcatgtagatagacatacattctttgtatctttctattttgggggggtaacggacactcttaattaggtttcattaattttctctgtttatctcacttttggaataatactttatttttgcattgcactttcacatcaaaaagggttaaaattcagtaaacatttattatatgccagatagtaggctaggttctttcatatatattaccttatttaattctcaaaacaaccctggaaggtagatggtatcgttttaaaccttgattttttttttttttttaattatggagagagaggcccagggaggggccatgacttgcccaagatcacagagtcggtaagaggtgaaaccagaccttgaactcaggtaccctgactccaaactcccaggtttcttctctcataccatccaacgtctcttgtgtactttatacagaaaacaggccgggtgcagtggctcacgcctgtaatcccaactactttgcaaggccgaggcgggcagattgcctgaggtcaggagttcaagaccagcctggccaacatgacgaaaccccatctctactaaaaatacaaaattagctgggcatggtggtgcacgcctgtagtcccagctactcgggaggctgaggtgggagaatcgcctgaacctgggaggtggaggttgctgtgagctgagatctcaccgtcgcactccagcctgggtgacaagagcgaaactccgtctcaaaaaaataataataataacactcttactccacggtgtgtaggctgagtactttctctcttttgaggctactttagtgttttcttttcttttttttttttttttgagatggaatttcgctcttgtcgcccaggttggagtgtagtggtgcgatattggctcactgaaacctctgcctcccaggttcaggcaattctcctgcctcagcctccttagtagctgggattacaggcgtgtgccaccacgcctggctaatttttgtatttttagtagagatggggttttaccatattggccaggctggtctggaactcctgacctcgggtgatccacttgccttggcctcccagaatgctgagattacaggcatgagccacgactttccgcctactttaacattttcttgctaacgtctgtctgcttaacatcctgaattagatagctataaatatttgatagccagtgtttgattatgtttcaaacaaagatggcacattctttcttttcatgaactttgaacttattgcacttgatctgttaaaacggcagtattgtgcagtttgtgtgtatgtcaaggcttttatttatgtatgtcactcatatccttgttttctgttttaaattttaggttcttggggtttttctctgtctgtgagtacttggtaaaaagttaaaccctaaagataaaaggcagcaaatagtgaccaaacgaatgtttttggcaaatacattggtgaaggcctccttcaggtaggtagagaggaggagggaagagggtggcctttcaggtggtaaagacagcataagctttatactactactataaggcctattctgtggatctctgatagatgagcagactgaagtaggtggtgtcttttgaggggcactgctgataacgttgggtagaaattttaaacaactttgaaagccaagtatggacatagccattagaagttttgttttttttgttttttggatatggagtctcactgcgatgtccaggctagagtgcaatggcacgatctcggctcactgtaacctacgcttcctgggttcaagcgattctcctgcctcagcctcccaagtagctgggattacaggcacgtgccaccacgcccggctaattttttgtatttttagtagagacggggtctcaactattattggccaggctggtctggaactcctgacctcaaatgatccgcctgcctcggcctcccaaagtactgggattataggcatgagccgctgcgtccagccagtttgtttttaatataacagtgatttggccaaagtggcattttgggagtaatgtctccagtttcaggtcggggtggtctagaaagaaattcaaatagcttgccttttgaggtgacaggaaccctgaactcttaaggcagtggttttcaaagtgtaggtctctcattagcagcatgagcattaactgagtgtctgggaacatattagaatgcaaattcttgggccccaccccaaacttactgaaccagaaactctggagttggggcctagcaatctgtgttttaacaagacaggtgattttgatccacgcaaaagtttgagaaccattgctgtgggttataggtagaaatggaaaggaagagatagaagcaagacacattggcagtgaaggactgactaaactttgtaactgatggatagcagcatgttatgatagagaagagtacttaattggggatgttgagccttgagttttagtatcaagtctcttaccaattgtgcttttattcgtatttatttatttattttttgagagggagtttcactcttgttggccaggctggagtgtaatggtgctatcttggctcagtgcaatctccgccttcagggttcaagcacttctcctgcctcagcctcccaggtagctgggattacaggcgtgcgccaccacactgcgctaattttgtgtttttttttgtagagatggtgttttaccatgttggtcaggctggtctcaaactcctgacctcaagtgatccacccgccttggcctcccaaagggctgggattataggtgtgagccaccgtgcctggcctatttttattttttgttttgagacagaatctcactctgttgcccaggctggagtgcagtggcctaatctctgctcactgtaacctctgcctcctgggttcaggtgattcttctgtctcagcctctccagtagcttggattacaggctcccaccaccacgcccggccaatttttatatttttagtagagacggggttttgccatgttggccagtctggtcttgaactcctgacctcaggtgatctgcccacctcggcctcccaaagtgctgggattacaggcgtgagccaccgcacccggcttccaactgtggttttttttttgagacagagtctctggctcctaggctgacgtgcagtggcgccatctcggcttactataacttccgcctcccaggttcaagcgattctcctgcctcagccagctgggtttacagccctgcgccaccacacccaggtaatttttgtatttttagtagagacagggtttcaccatgttggtcagagtggtctcaaactcctgacctcgtgatcctcccacctcggcctcccaaagtgctaggattagaggcgtgagccaccatgcccggcaccaactgtggttttaaacaagaaaactgacctgtccttgttgaagttgtacagtgtgctttctgaggattttgaaggcaaagacaaatgaaatactaaggtagactttgggatttagcttggattaccaggaagactgggggaaagattttttgaaactttgaggagagaatatgagtggatgaggctttagacagttggagatactagaagatttaaagcagattctcaactggggatgattttgcccccaaggaaacatttagcagtggacatttctgatggtcagactggggtagtgctactggtatttaatgagtagaggctagggatgctgctaaagcattctgcagtgcacaggacagccctaactacgatgaatgaacaggtccagaatgtcagtagtacaaggttgacaaaccctgatgtaaagggaaatacccagtagataggttgcatgtttccgtcctgattatctgctattcattttataattttattttttaaagttttatttatttatttactttttttttgagacagtcaatctgttgccgaggctggaatgtagtggtgcgatctcggctcacttaaacctctgcctcttgggttcaagtgattctcctgcctcagcctcctgagtagctgggattacaggtatgcgtcgccacgcccagctaatttttatatttttagtggagacaggatttcgccacgttgactaggctggtctcgaacttctgacctcaggtgatccacctgcttcagcctctcaaagtgctgggattacaagtgtgagccacctcacctggccttgaattttagataaatctaacacaaaacatctcaaaagcagtctcacattgtgtttcccacatcatgctttgcaaaagtaagcatgaagccctttttctgttgttgaattttcacaaaactaacttcatggtcatgacaatcctcaacccagttgcatattttctttactccttttaacatacgcaaagatcaacttatttcggtaacataagcattcactgtctagacatcagtcattaagctacagcagataagattttcttttttttttttccccctgagacggagtttcacttttgttgcccaggctggagtgcaatggcgcgatctcgtctcaccacaacctccgccttctgggttcaagcgattctcctgcctcagcctcccgagtagctgggattacaggtatgcaccaccctgcccagctaattttgtatttttagtagagaaaaagtttcagcatgttggtcaggatggtctcgatctcttgacctcgttccacctgcctcggcctccaaaagtgttgggattacaagcgtgagccaccgcgcccagcacagatttccttttgatactctctttgaaggatagggaaatgagataaaagttgtggtgctgttgtgagcaaatgttaaaatatttttaattgccctgtagctgaagaccgcatgatcactctgaaaaactgcctcatgagctggttgtggccctcagccttaattcatctctttagatcctggatcacagacgttagcaacttttttgtttgtcaaggcagtaatctgcgtaaatgactcgtttctgagagtgacctcaagataatatatattcataaatgtagtgatcgttttatagtagttttatagtttgcaaagtacttctttgtctcttgtgtctttttgtcattttagtcttttgatcatcaccatcttagtcttttgatcatcaccattcttggggttgccagaacttgtggacagtgctacatgttgggtaatcccaaaagttgccattcacatatcttaatctatgtgaataaagatgcccttggaattcaatggtgcacaccctgtagaactatgaactgatgtttctacccactactgaagtctagattctagatagctcatcctatcatatactttcattgcattctgtgtttacctttgttgcctttgtgtaactataattaacgttactagtgtgtttgtttaatatctgattttttcaccaggccagaaaccatttttgggggataaggtaaaggaaaagtcacactgcatatttgaaagtaggagataaaaacccaatctcatggataatagcacacattgattgaatgtgtactgtgtgcttggtactggcattttcgatatactcactaatttaattctcaagaaccctttgaaatggattctttgactcccattttaaagttttggaaacagatccaaagtgcagttaagtgtctcagattatccagttaagggacagagccaggattcaaagtaaacagtctggtgattccagagcatacttaagttatactgcctcttcatcaactttgttgggacacagtttataaatgtttcactgatgaattgagggtgtttcccaagtcatctgttctcattcaggagattcattcacttaaacaaatgtttgttgagtgcttatgttgtactaagcattttatttgggtcttctaaatgctgtggtttcagataatgctgagtgctttgaagaaattacaaggatgatgagatacttgtaggatggagaattccttgagattgagtgatcagtgaaaggcttcttgagaaggtggcattttgtactgagacctgagtgatgaacagccaatcttgtgatgttcaggggttctggggaccaggtctggggccctaggtatagggaacaggcaatgcaaagtcctaaggtaggaatgagaaaataatactaagcatttaaccatgttcagataccatgtagggcgctctggcttacagtaatggataaaacaggtatggtccctctgtcatggagcttctggtctggtggaaaagtcagacattaaacaaatactagtaatgttaattacagttacacaaagggctacaaaggtaaacataggctgcagtaacagtatatgatagagtgagctaatctagacttcagtagtagatagaaacattagagaacactttcctgagagaggctttgaagttgagacctaaagggtgactaggaggtaaccaggcaaagatgcagagtgattagcacatgcagaaactcttaaggttggaaagaatttgacatgtttgagaaacctgccaaccagctaagccaaccaactaaacaaaacaccaaaaaagccattgtaactgaagaaacataagtgaaggagagagttaaaattcttgacaaggtagacaggtcagatcaaatagggcattatcctgaagccattgggaaggcagaagttcagcagagtagtaatgcgtttggaccaatgtcagtggttgcaatgtagagaaagggtcagggagagggcaagaatagatttagggagattaattaggaggctattatattggttcaggtaagacaatgatgtggtatggttgagtgctgacagaactagagaggagattgattctatgattgagattctatgattgattctatgagaactatatatgaaatagaatcatgggacttttcattgaatgttttgagggtcagtgtaaaggaggtaaatataagtatgactcccaagttttcctagtgcatggcttataatacagttcttttattgaaatagggtacactgaaggaagagcaggtttggggactgagcaaaggagcataagttcagttttgagaaaacttgaaaaggttaaatgagaagtgcttgtgaaatatcacagtagaactgttgagtaggtaattgggtatgattctgggtctaaggaaggacttactggcatatgattgggtctttttttgagaaggggtctcagctctgtcgcccaggctggagtgcagtggtgcgatctcggctcactgcaacctctgcctcccaggttcaagtgattcttctgcctcagcctcctgagtagctgggactgcaggcatgtaccaccatgcccggctaattttttgtattttagtagagacggggtttcaccatgttggccaggataatctctatctcctgaccttgtgattcgcctgcctcagcctcccaaagtgctgggattacaggcgtgaaccaccgcgcctggccaaactatagtattattataggaccaccgtcacatatacagttgttgagtgaaatgccgttaagtggcacaagtctgtatttgaccgtgagtctctttttacctagtaagagtagacttctgtaagtcaaggaatatgctttattcaggtgctcaaaacttgtctattgaattgaacaaaaatgtgttatgtagtcctaaaaatacataaaatgtagagaacacagtaagtgaatttcaacaatgaaaagaaccttagattgctaatcaggttgcataggttagttatctagctttattttattcacctacaaggttcttagttctaataatttaaaccagttgttttcaaagtgtgctccccagaccacattacctgggaactagttagaaagggaattcttgggctgggcacggtggctcacacctgtaatcccagcactttgggaggctgaggtgggcagatcagcagaggtcaggagttcgagaccagcctgaccaacatggcaaaatcccatgtctaccaaaaacacaaaaattaaccaggtgtggtggtgtgcacctgtaatccaacctactagggaagctgaggcagaagaattgcttgaacctgggaggtggaggttacagcgagccaagattgtgccactacattcttggatcctaccccaaacgtactgaatcagaaagtctggcagtggggactcaacagcctgtgtttcaactagttctccaggtgattctgatagatggtaaagtttgagaaccattggaattgttgtagcagtttttctgtttgttggaaacaaaaaattaactagaggtagttaccttaatttcacacttcacagcttaaagttattttaaaatcgtttcttcatatttcctgccagttgaatttgctgacatttttctaaaccactaatggtatcttaggcacagtatccttgaatcacaggcagtagtattaagtttctgaagactgcttctccccccaccatgctccttaagtcttatttaaataaccttcagtgagtacagaaggggcccattactacgcccttcctggtgacaccagttaaccaagccagggcaagtaagtgtaccctgcagccctgccagccaaagattgctactttttttttttttccttttttcttttttcttttgagacggagtctcgctttgtcccccaggctggagtgcagtggcatgatctcagctcattgcaacctccgcctcccaggttcaaatgattctcctgcctgagcctcccaagtagctgggattacaggcacccaccaccacgcccagcacatttttgtatttttggtagagatgggttttctccgtgttggccaggctggtcttgaactcctgacctctggtgattcgcccacctcggccccccaaagtgctaggattacaggcgtgagccactgcacccagcctctttttgttttttagagatggatctgtctacgttggttgcccaggctggtcttgaactcctaggctcaagtgatccttctgcctcagcctctcaaagtactagtattacaggcatgagccaccacgactggcccaaaggttgcaaggttgctgctgctatttttttttttaatttattttttgagacagagtctcgctctgtcactcagtctggagtgcgctggcacgatcttggctcactgcaacctttgcctcccgggttcaagtgattcttctgcctcaggtcctgagtagctgggattagaggcatgtgctaccatgcctggctatttttgtatttttttagtagagtccgggtttcactgtgttgcactggctggtctcctgacctcaactgatgtgtgcatcttggccttccacagtgttggaactataggcgtgagccaccgcacctggcctactcctgtgttcttagcttgagttcctggttgatgggtggtgccaccaattgagagagaataccatggtttgtggattgggtacggtggcttacacctataatcccaacactttgggaggctaaggcaggaggagttcaaggcttgagctcaggagttggagactaacctgggcaacatggcgaaatcccgtctctccaaaaaatacaaaaattagctggctgtcatggcgtgtacctctagtcccaggtaattgggaggctgaggtggaaggatcacttgagcctggaaggtcaaggctgcagtgagctttgattacgccactgcactccatcctgggtgacagagtgagatcttgtctcaaaaaaaaaatatcatggttttatacaaagaatataggtcggaagaccaccctgagcaacatagcaagactgtctcaagaaaaccttaaaagaagttacaagtaggcctggtgcgatggttcactcctgtaatcccagcactttgggaggtggaagcgggtggatcacctgaggtcaggagtttgagaccagcctggccaacatggtgaaaccctgcctctactaaaaatacaaaaaattagccaggcgttgtggcaggcgcctgtaatcccagctacttgggaggctggagcaggagagttgcttgaacccgtgaggcggaggttgcagtgagccaagattgtgccattgcactccagcctggcaaaaagagtgaaactttgtctcaaaaaaaaaaagttacaagtatacttttgatttatttatattaacctttctgtctctagtagcatatttaattcaccagttatttattgggtctactttatgaagaaccttaccagagattctgggttaacgtcatgaggtatcaccatagatttggatcactttttattaggtagaactagtttaaaaaacgctatattttaattactgcatggattacttaatttttctccagacctcttacctcatgcttgctcaagtcaaaggttgataaatactactcatttagctttgtgggcactttctcagtttatccccctctctttggagtgtcactccacgttgtctcatcgatgaaaatattaggaactctcctaaacattgtattttggggaacacaagcatctgaagatacccatccatttacttctgtcccttattatttaaccatttcttcatatgcgaaacaatttttccatattgttttgggggtacatgtgatactttattagatgcatagattgtaatgaccaagtcagagtatttggggcatcttatcaccttgaatatttaataggaacatttcaggtcctcctctcaagctattttgaaatatacaattcattgttattggccgggcgcggtggctcacgcctgtaatcccagcactttgggaggccaaggcgggcggatcatgaggtcagaagatcgagaccatcctggctaacatggtgaaaccccgtctctactaaaaaatacaaaaaataagccaggtgtggtggcaggtacctgtagtcccagctgctcgggaggctaaggcaggagaatggcgtgaacccgggaggcagagcttgcagtgagctgagatcgtgccactgtattccagcctgggcgacagaatgagactcgttccaaaaaaaaaaaaaaaaaatatatatatatatatatatatataaaattcattgttactaattatagtcaccctacttacgattgagcttcagaacttattccttctaactgtatgttcatgcccattaaccatcctctctttatgcacccctttgcccctcatacacacccttcccagcctctggtgtccatcattctgttctctgtttatgagatcagctttttagttctttaatatttgagtgagaacacgtgatacttctctttctgtgcctggtttatttcatgttatttaatattctccaattccatccatgttccgaaaatgacagaatttcattcttttttatggatgaatggtatttctttcattcattcattcattcatttttgagacggagtcttgctgtgtcgtccaggctggagtgcagtggcacgatctccgctcactgcaacctccacttcccaggttcaaatgattctcctggctcagcctcctgagtaatggtttacaggtgtgcatcaccacgcccggctaatttctgcatttttagtagaggtggggtttgaccatgttggtcaggctggtctcaaactcttgacctcaggtgatccacccgccttggcctcccaaagtgctgggattacaggcatgagccaccgcgcccactgtatatctagtttttttagggcattaaaaataaggctgggtgtggtggctcatgcctgtaatcccagcactttgggaggccaaggcaggcggatcacctgaggtcaggagttctagactagcctggccaagatggtgaaaccctgcctctactaaaaatacagaaattagccgggtgtggtggcaggtgcctgtaatcccagctactggtgaagttggccggggggttggggttggggttggggttggggttggggttgggggggcgtcaaggcaagagaatcgcttgaacctgggaagcggaggttgcagtgagccgagattgcaccatcgcactccagactgggggacaagcgtgagactccatctcaaaaaaaaaagttagaaataaaagtacaaggagctcaattatgtatttgtttttctgtgtttcctattaaatccttattcctagaagtacagtaattaaaattagaaacatttaaaaaacttactatggaaagattatatgaagtaaatagtggtgtgattaacacccatatacccattgccaagcttcaacaattatcaaaacttggaaatcttcttttatctctatcttctactccctctcagttgtcttgaattaaatcccagatagtattacttcatctgtaaacacttcagttatatatatatatctattcttttttttttttttttttgagatggaatcttgctcttgtcgcacaggctggagtgcaatgacatgatctcagctcactgcaacctctgcctcccaggttcaagtgattctcttgcgtcagcatcccgagttgctgggatgacaggcatacaccagtacactcggctaatttttgtatttttagtagagacggggttggctggtcttgaactcgtgacctcaggtgatcctcccgcctccgcctcccaaggtgttgggattacagccgtgagccactgcatctggcctgtctgttcatttcataaacatctgagagggtctttgctacaggacttcaggagcactagcatcggtatgaaatagtgttggttcagtttctgaaaatttcttgggaagaagcacatgcagaaaagtccgtaaaacataaatttatatggtgtagtgaataagcatgaagcaaatacctgtgtaactactactcagtcaagatttgaaattgccaccacttcaaaagcttctttacaaccttcctaatcactactttttcttactcagtggaattatattttagtttcgcttttgtctgtctgtctttctctttttatttatttatttatttatttatttttttgagatagggtctcactccatctcccaggctggagtgcaatgacgcgatcttggctcactgcaacctctgcctcctgggttctagagattctcctgcctcagcctcctgagtagctgggattacaggcgtgtgccaccatgcccaactaatttctgtatttttagtacagacagggttttctcatgttggccaagctggctcaaactctttacttcaagtgatccgcctgcgtcggcctcccaaagtgctgggtttacaggcatgagccactgtgcctggccttaaaaaaaactatttttttttttttgtgagacggagtctccctctgtcgcccagactggcgtgcagtggtgcaatctcggctcactgcaacctccacctcctgggttcaagcgattctcctgcctcaaacctcctgagtagctgggattataggtgctctccaccactcctggctatttttgtattttttttagtagagttggggttttaccatgttgcccaggctggtctcaaactcctgatgtcacgtgatctgcctacctcccaaagtgttgggattactggggtgagccattgtacctggcccttggccttaaattttttttttttttttttcaagacagagtctcactcttgttgcccaggctggagtgcagtggggtgacctctgctcactgcaccctccacctcctgggttcaactgattctcctgcctcagcctctcaagtagctgggattacaggcatgcaccaccatgcctggctaattttgtatttttagtagagttggggtttctccatgttggtcaggctggtcttgaactcctgacctcaggtgatccacccacctcagccttccaaagtgctgggattacaggtgtgagccaccgtgcccggccccaacattttttttaatataaattttttagagacaaggtcttgctctgttagctcatccaggctggagtacagtggaacagtaatagctcactgcatccacagtctcctgggctcaggtgatctgcctcagcctcctgagtaactgggagtaccggcacgcaccacgaagcccagctaatatttggtattttttttgtagtgatgggtttctccatgttacccaggttggtcttgaactcctggcctcaagtgatcctcctgcttcagcctcccaaagtgctgggattataggtgtgagccatcgtgcctggatttttatttttatttatatttttgagacagagtctcgctctgtcatccaggctggagtgccagtggcgcaatctcagctaactgccgactttgcctcccgggtcatgtgattctcctgcctcagcctctcaagttgctgggtgtagaggcccccaccatcatgcccaactactttttttgtatttttagtagagacagggtttcaccatgttggccaggcgggtcttgaactcctgacctcaggtgatctgcccagcttggcctcccaaagtgctaagattacaggtgtgagccaccgtgcccgaccattcacatggtttttaaaatttgatccttgaggctaatcgctgttgctcatgtctgtaatcccagcactttgggaggctgaggcgggcagatcacctgaggtcaggagttcgagaccagtctggccaacatggtgaaaccccgtctacaaaaaacacacacacacaaaattagccaggtgtagttgcgtgtgcctgtaatcccagctacttgggatgctgaggcaggagaattgcttgaacccgggaggtgtaggtgccagtgagctgagattgtgccacttcactccagccttccagagtgagacttcattttaagaaaaaaagataaaaattgatctttgagccatccctttgagggggaatatggtagcaccccattttttttttcattaggaaataaaggctcatagaggcaaaattacttaccctaacgttatactactaagcagtagaacaaagactggacacctggtattctttgttcaggttgaatttctttccattataccatattctccctttctcttttctcattacttgaaaatgataccatactcggctactttctcttttcttaatgttttatgccctcttatttacttttggacctttgcgtatgctgttctttctgaatcatacattttccttcctctctaactctgcctttcaggtttcaggtttcagcttaagtgttacatcctttgggaatttttttttttttaattcctgcttttcatgaactgtatccgggagattttcaacatgtttctctgtttctggtatataaaatgcctgttcttcccgttttttgttttgtttttttttgttttttttttttgagacagagtctatctctgttgccaggctggagtgcagtggcgcgatctcagctcactgcaacctccacctcccgggttcaagcgattctcctgtctcagcctcctgagtagctgggatttcaggcgcataccaccacacccagctaattttttttctatttttagtagagacagggtttcaccatgttggccaggatggtctcaatctcctgacctcctgatctgcctgcctcagcctcccaaagtgctgggattacaggcatgagccaccgcacctggcccccatttctttaacatttgatttttctgctgtcataagaaataatacaccgattgtctttttacttactttttatagatcctgagggcaaaaatcatggcagtcttatttatcagagcattgacagtgtttggcatatggtagaagttaaaacatttaatgaattcagttgaatataattttctatctactgtgacagattctctctctttgtctgtcttcctttttattgtttgagacagggtctcactttgttatccacgctggagtgcagtggcataatctaggttcactgcaacctccacctcccagacttaagcaatcctcctgcctcagccccacaagtaccagggactacaggtgcttaccactacacctggctaattttttgtaatttttgttgagacagggttttgatgtgttgcccagattggtcttgaacttctgacctcaggtgatctgcatgcctcagactcccaaagtgctggtgcatgagccaccgtgcctggaacattctttaatattggttataaactctaatgccatgctttcctccctcactttcgtggattttatctatttattattccttaactggaatacaaataggtttcataaaagtttatcaaaggcacatagtttactgatctcatttgagatcatgttaatgtttgaaattcccttgaacctcactgaagactaaggttaatttgtagcaatagttaaaatttgcttagtcagatataaatagccagaaaacctaacaggatggaagttgaaacagagctaagatttatgaaagtgtctgccatgtaagtccgatgtatgtcatcaacttaaaaatgaacactgttgttgacagtttggtgtaagagaatagaaatacgcctgtttgtatttcatccaggcttggccagatcttttgtgccactctgggaatggtcaggttaaaagatatgacttccactgggccgggtgcggtggctcaagcctgtaatcccagcactttgggaggccgaggcgggccagtcatgaggtcaggagattgagaccatcctggctaacacggtgaaaccccgtctctactaaaaataaagaaaattagccgggtgtggtggcgggtgcctgtagtcccagctactcaggaggttaaggcaggagaatggcatgaacctgggaggtggagcttgcagtgagccgagatcgcgccactgcactccagcctgggcgacagagcgagactccgtcttaaaaaaaaaaaaaagatgcaactttcactggatttcaagagccagtgaacctagttaaaccttattaaagcaggaagaagtgagaatttcaaggatcaagggctttctctggagactgagtagttccctttcattagagattctttttttttttgagatggagtcttgcagtgtcgcctgagctggagtgcagtggtgcaatctcagctcactgcaactgccgcctcctgggttcaagcgattctccagcctcaaccttccaagtagctgcgattacaggcgcctgccaccacacccagctaattttttgtatttttagtagagacgaggttttaccatgttggccaggctgttctggaactcctgacctcgtgattcacctgcctcgacttcccaaagtgcggggattataggtgtgagctgccacgcccggccctcattagagagtcttatagcaaatgtctctagctgatcatctagtggtaatgtaaatcagctaagtacatacatattgattgattgacttaaagtatttactagatcgctgatttgttacaagcatttgttacttttgcattcctttaagaaaactttggggctgggtgcagtggctcatacatgtgatcacaacactttggtagaccaaattgggaggatcatttttgaactctggggtttgagaccagcctggacaacattgcaagaccgcatctctattaaaaaaaaaaatttagctgggcgtggcggtggacacctgtagtcttagctgcttgggaggtcgaggccaaagggtcgcttgacccccggaggttgaggctgcagtgagctgtgattgcaccactgcattccagcctagacaacagagtgagacctaattcaaaaaagaaagaaaataaaataagggttttttcatggggtaaaactcaaataataggtatcaatcatatcttttttcccccatcagaaacaagtaatccggccgggcgtggtggctcatgcctgtaatcccagcactttgggaggccaaggtgggtggatcacctgaggtcaggagtttgagaccagcctggctaacatggtgaaacacagtctctactaaaaatacgaaaatgaactgggcgtggtggtgggtgcctgtaatcccagctaattgggaggctgaggcaggagaatcacttgaacccgggaggtggaggttgcagtgagctgagatcatgccattgcactcctgtctgggctataagagcaaaattccgtctcaaaaacaaaacaagacagacaaaaaagaaataatccacaccctaaagtgcgattcagctgaaattgtctatggtattttgcctagaattaaccaaaagagctggggtaggggctggtggcgcatagctcagcattacagatctacttaaatcttgtaaactatttataggtttgggttgttataacatgtttagcatggttaataagccaatcaagaaatatcccaaaacgttcatttttgcttcctttacagatggtggcagatgaaaaagcagatttttttcccctgaagctctttaataatggcaaaagttaaaaagtgttttctctgtagtcctgaatttactgaatgtattcccttcctgaataaattgactgttcccttagtgtagggctataacctggttttggtggagtcccttccaggttctaacatttgtgtgaccttgaacagggtacttcttaacctttctgagtctcaggtttattcatttctaaagtgcaggtggtactgataccttttagggttggttgaggatttaatgggataatgaatgtagactgctgtgccaacagtgagctttcaataaaaggtatctgttgtaattctcaaagcttaatacgttattatatataacaagccagttttacgccttttaaatctgattttttagttatatagataacatatatctgtattattgtagaaattaaaattttacagataaggctaaagagccccttagccaccttaatcctaaccccttcaccagatgtaatcattttattagttaatatatccttccatgtctttttctttgcttttatgcatacatacacatgcattttaattttatagatgaagaatagaaaagatagtaatctaattttataaatattaaattactaggtattagaatctttttttttttttttttgacagtgttttctcttttttgcctaggctggagtgcgatgatacgatctcggctcactgcaacctcggcctcccaggttcaagtgattctcctgcctcagccacccaagtagctgggattacaggcatgcgccaccagtcccagctaattttgtatttttagtagaagagcggggtttcaccatgttggccaggcaggtcttgaactcccgacctcaggtgacctgccctcctcagcctcccaaagtgctgggattacaggcgtgagccactgcgcatggcctagaatctgtattttagatactcagtaaacaaaagatagcaaaattcaacaattcgttgtgtaatgacagatcttacacgaaattacagaattctttacaaccctagacaagtttaattaaagggaagaaactaaaaagtaagaaacagctacagctgtttagcccggaaatatgcatttgtttttctagccgataaatagatcagaacttaagaaattcactgcctctcagtttacctcaaattttacaactaagggccacaggtattatttgttagtctgacaagtaaaaaatgatgttttcttttctcaaaaatgtgaaaaatttaccaccaccttgttgggccaaaggagaggttgggggaagagaagagtaattgaaactgctttctgcatatcattgattctcaagtgtatttaaattatttttgtagtaatctatagtatttttggtttttgtttgtttactattagtacacattggaaagtggattccaggccaattagggaaggagattgattttgaaatgatgttagttctctggaaaccacttgtttaaataagggaatatcaagaggaaagggctggccatagttactaatcctttgagaggagggatctaagagttggaggatatgtcagacatgatctctcttctctggggaattagaggtgagttggagaaaactgtgggagagagggtcagcagacaaggtgaaagatcacttgagtctagtagtgtgagaccagcctgggcaacagagcaagaccccatctctacaaaaataaaattaaaatgccaaggtaaatggtgttaattctaaacattttggaggtgggggtggggtggagaatggagcatagcattcacctcttctttcatcctagtcttcagtctaaacctagtgttgaaggccaaaggacaatactcccatacacagtgtgagtgggagggagtatgtagtaaaccccccttgcatgcagtagagatgtgatattctcctttgcttggaggatatcatggtggatagtagaagcaggggttcagtttagtttgtaagttataccttggtaactgtatgtttgaccaattatgctgaaaatacagaactgtttcagcatacgttgctttaggagatacacatacatatattgaatcactctcttggtggctgattttttcagctttggttctgctgctgcttccaacagcctagagttgtgttgtacgctatggtagccactagccacaggttgctagggagcatgtgaaatgtggctactatgaattaagatgttggtgtaaactatacacaccacatattttatttattattttattttatttttaaatttaattttattattttattttgagacagagtttcactcttgttgcccaggctggagtgcaatggtgccatctctgctcgctgcaccttccgcctcccgaataagtggggttacaggtgtctgccataatgcctggctaattttttgtatttttagtagagaccggggtttcaccatgttggccaggctggtcttgaactcctgacctcaggtgatctgcccacctccacctcccaaagtgctgggattaacaggtataagccactggacccggcctcaaatcctgaagacttggtatgaaaaaaggattaaaatagccccataattttttacattgacgatatattggaatggtattattattatttcttatttttttatttttatagagacagggtttcactcttacccagactggagtgtagtatggctttatctagcttactatagccttgaactcctgggcttaagcaattctcttacctcaacctcctgcgtagctaggactataggcatgtaccaccacaccgggctaatttttttaatttttggtagaggcaaggttttgttacattgccctggcctgaaatggcattattgattacatttgaagtgatttactgggttaaataaaatatattattaaaattaatttcccgccgggtgcagtggctcacacctgttacaccagcatcttgggaggccgaggcaggcagatcacttgagcccaggagttgaagaaccgcctggtcaacatagtgaaaccctgtgtctattaaaaataccaaaaagccaggcgtggtggtgtgcacctgtgcttccagctacttgggaggctgaggtgggaggatcacttgagcccaggaggcggaggttgcagtgagccgagattgcaccactgcactccagcctgggtgatggagtgagaccctgtctcaacaaaaaattaatttccctgggttgggtgcagtggctcacacttgttattccaagtattttgcgaggctgaggttggagggtcgtttgagaccagcctggacaacagagcaagagacctcatctctacaaaaaataaaataaaaattagctgggcatggtggtgcacatctgtagtccttgctacttgggaggccgaggtgggaggatcgcttgagcctgggaggtcaaggctgcagtgatctgtgatcatgccactgcactctagcttcagtgacagagtaagaccctgttacaaaaaaaaaaaatcccttaaaaattggctaccggaaaaatttaaattacatatgtagcttacattttgtttcttttgagctccactggcctggaacaacccataccagggataagtacttcttttatcttgctgtagaatttcatatggatcattccatagcagatgtttaatgatttcagttcagtaagaatatttaagttatttaacttttgtagaatcagattttttttttgctagcaaaacaaaagcatttttaattttatatatcagtgagactataggattacagtgccagagtgtgtgtgtgtgtgtgtgtgtgtgtgtgtgtgtgtgtgtgtgtgtgttttcaggaattcctcttatagtgttcatggtatgtctttttttttttggagactgcgtttcactctttctgcccaggctagagtgaaatggcacgatctcagctcactgcaacgtctgcctcctgggttcaaaccattctcctgccatattctcccaagtagctgggattgcaggcatgtgccaccacgcccagctaatttttgtatttttaatagaggcagggtttcactatgttggtcaggctggtctcgaattcctgacattgggtgatcgacccgcctcggcctcccaagtgctgggattacaggtgtgagccactgcacccggctggtgtgtcttaatatgcatgtttacaaggacgtgtaattggaaaggtgatgcttttctgtccaagaaaaggtcctggaaccaggtgtattcctcaacccagtttttagacaccctggctcccaaagaatgagggaaatttggtttaatgtgtcatcaaactttgtattcagctatctagagccattttctggattcatgcaatacattttccccaaaccctttttattttgaaaaagctcaaacacagaaaagttgaaagaatagcgtaaagaacatctggatgtggtgcagggtctcatgttcataatcccagcacttcggaaggattatttcagaccaacctgggcaacatagtaagacccaatgtctacaaaaatgtttacggataaaccaggcgtggtggtgaggtagtcccagctactcaggaggctgaggtgggaggattgcttgagcccaggagttcaaggctgtagtgagcaataatcacatcactgcattccagccttgagtaacagtgagaccctgtctcaaaaaaaaaaaaaaaaacaccaaaaacaaccaactgtgtatatcttgcactgataatcccctttttttatttttaattgtcacatttaaaattttctgttgtttttggctgagttatttgaaagtaatttgcatacatcatgacacattattcctaaatgttttagctgcctctcctaagaataagaacatgatcttaccacagatttacggttatactgaagaaaattcaaattccataatgtctaatatttagaattttccaatgtcctaaataaaattttatagctctcacttgacttcagtccacgtttatgcattatatttgactgttgactctttagtcactcagtgtattaatagaatagaggtgaactacaacccatgtaccaaatctggctcgtcatttgattttgtacagcccatccaataagaatggtttttacgtcttttaatatataattgttttaaattgaggtaaaatttgtgtaacagaaaattaaccattgatcatttagaagtgcacaattcagtggtatttagtatattcaaaatgttttgcaatcatcacctctggctttctgtctctatggatttacctattctgggtgtttctttctttctttctttcttttttaagacagagtttcactcttgttgcctaggctggagcgcaatggcgtgatttcagctcactgcagcctctgcctcctgggttcaggcgattctcctgcctcagcctcctgagtagctgggattataggcacctgtcacacacctggctaattttttcttttttttttttaggtagagatggggttttgccatgttggccaggctagtctcgaactcttggcctcaggtgatccacctgccttggcctcccaaagtgttgggattacaggcatgaaccaccatgcccagcctgggtgtttcatgtaaatggaatcatacaatatactgtatgaccttttgtgtctggctttcacttagcatatgttcgaggttcatctgtgttttggcatgtatcagcatcttatttctttttatggctgaataatattccgttgtatggatataccacattttgcttattcattcagccactgatggacatttgggttgtttctaccttttagctactgtgaatagtgctgctatcagcatttgtgtgtaaatatttgaatacttgtttttagttcttttgttttttgtttgttttgagacagtctcagtctgtcactcaggttggagtgcagtggtgccatcttggctcactgcaacctctgcctcccaggctcatgcagttctcatgcctcagcctcctgagtagctggggttgcaggtgcctgccaccacacccagctaattttttgtatgttttgtagagatggggttttgctatgttggccaggctggtctcgaactcctgacctcaagcagtctgcctgctacaggcataagccactgcgccccagcctagcagtttatacatttattattgttttaagagtcagagtctcaccctgttgcccaggctggagtgcaagcagtggactgatcatggttcattgcagcgtcatactcctaggctcaagcgattatcctgtctcagcctcctgcgtatctggggctgtaggcaggtaccaccttggctaagttttaaattgttttggaggcaaggtcttgctgtgttgcccaagctggtttcgaactcttggcctaaaatgaccctcctgcctcagcctctcaggttgctgggattacaggagtgagccactgcactggcttggtttttatttttatttttatttattttttgaaacggagttttgttgttgttgcccaggctggagtgcaatggcttgatcttggctcactgcaacctctgtctcccgggttcaagcaattctcctgcctcagcctcctaagtagctgtgattacaggcatgtgccaccatacccagctaattttgtatttttagtatagacggggtttctccatgttggtcaggctggtttggaactcccgacctcaggtgatccgcctgcctcggcctcccaaagtgctgggattacaggtgtgagccactgcgcctggccggtttttattttttaaacggctaaaaaaaaaaaaaaaaaaaatcacaggaagggcggggcgcagggctcacgcctgtaatcccagcactttgggaggctgagggcagacggatcacctgaagtcaggagttagagaccagcctgaccaatgtggagaaaccccgtctctactaaaaatacaaaatagctgtgcgtggtggcacatgcctgtaatctcagctacttgggaggctgaggcagaagaatcacttgaacccaggaggtggaggttgtggtgagctgagatcatgccattgcactccagcttgggcaacaaaagcaaaactccgtctcaaaaaaaaaaaaaaatcacaaggaggataatattttataacatatgaaagtattggctgggcgcagtggctcacgcctgtaatcccaacactttgggaggctgaggcaggtggatcatgaggtcaggagatcaagaccatcctggccaacatggtgaaaccctgtctctactaaaaatacaaaaattaggccaggcgcggtggctctcggctgtaatcccagcactttgggaggcgaggtgggcggatcacgaggtcaggagatcgagaccatcctggctaacacagtgaaaccccgtctctactagaaaaatacagaaaattagccgggcgtggtggtaggcgcctgtagtcccagctactcaggaggctgaggcaggagaatggcgtgaacccgggaggctgagcttgcagtgagccgagatggcgcctctgcactccagcctgggcaacagagcgagactccatctcaaaaaaaaaaaaaaaaaaaaattagctgggcatggtggcatgtgcctgtaatcccagctactgaggaggctgagtcaggagaatcgcttgaacctgagagtcggaggttgcagtgagccgagatcgcgccactgcacttcatccagcctgctgacagggtgagactctctcaaaaagaaaatatgaaataggagcttcagtgcccacaaataaactcgtgctcattcatttaacatgttgtggtagaggctgtatggcccacaaaatttaaaatatttaccctctggcccctttcattaaaagctggctaattggctgggcacggtggctcacgcctgtaatcccagcactttgggaggccgagaagggccgatcacgaggtcaggagatagagaccatcctggctaacacggtgaaaccccgtctctactaaaaatacaaaaaattagccgggtgtggtggtgggtgcctgtagtcccagctactcaggaggctgaggcaggagaatggcatgaacccgggaggcggagctggcagtgagccaaaatcgcgccactgcactccatccagcctgggcgacagagcaagactcccgtctcaaaaaaaaaaaaaacaaaaaacaccacacagttggcaaattttgaatagtctttcgtgtgtgagtgtgtgtgattgactttttaagtagtaaactttattttttaaaagcaaaaaaattcctggtttctcttattaacatcttgtggccgggtgcagtggctcacgcttgtaatcctagcactttgggaggccgaggggggcggatcacctgaggtcaggggttcaagaccagcctggccaacatggtgaaaccccgtctctactaaaaatacaaaaattagccagacacagtggcacgcgcctgaaatcccagctactcgggaggctgaggcacaaggatcgctggaactggggaggtggggtttgcagtgagctgagatggcgccactgcactccagcctgggcgacaaaagcaagactccgtctccaaaaaaaaaaaaaaaaaacttgcattagtgttgtacatttgttacaactgatgaaccaataatgattcattattataagctgggtgtgggtacctgtagtctcagctactccaggtggggctcacttgagctcaggaattggagtctagcctgggcaacatagtgagaccccatcgcaaaagaaagagagagatacattgttatttaactataactgtaacctcatgtttatagtttaaattaggtttccctgtttgtgttgtacagttctgagttttgacaaattatccaccattacagtatcatatagaatagtttcactgccttaaaaatctactgtgcaccacttattcatcccctttcctctcccccatacaccagcaactacggatctttttgctgtctgtagttttgccctttctaaaatgtcgtatagttggaatcatacagctttttcagactggttagcagtatgcatttatggttcctccatgtctctttgtggctacatatctcatttctttgtattgttgaatattgcattgtatggatgtttcatagttcatttattcatttacctattgaaggacatcttgattgcttccaggttttggcaattatgtataaagccgctctgaatatttatgtgtaggtttttgtgtggacatgagttttcaattcattgagtcagcacattttatggtaagagtgtttagttttgtaagaagctgccaagctgttttccaaagtagctgtactattttgtattctgaccagcagtgaatgagagttcttgttgctttacctccttgccagcatttggtgttgtattttcaattttgaccgttgtgtagtggtatctcatagttttaacttgcaactccctaatgatgtacaatgttcagcatcttttcttttttctttttttgaaatagagatggtgtctcactatgttacccgggctggtcttgaactcaagtgatccttctaccttacatgcccaaagtgctcgtattataggcgtgaaccaccgcccccagcctgagcatcttttcatatgcttatttgtcatctgtatatcttctctgtttagatcttttgcttactgttttattgtgctggtttttttattgtgatgttttaaaagttgattgtaaattttgagtattaagtctttatataaaatatgtgttttgcgcatttctcccagtgagtggcttgtcttttcattcctttgacagtgtctttcacagagcagaagttttcagtttcattgaaatccagtttattaattatttttttcatggatcatgcttttggtgttgcgtctaaaaacccattaccaaagccaaggccacttaggctttctcctcttatcttttagaagttttatagttgtgtgattttcatttaggcctatgatcttttttgagttaatttttctgaaaggcataaagttagtgtttagatttatttagttattttgcttgtggatgttcagttgttgcagcaccatttgttgagaagactacctttctacatccgagttacctttggtcctgtgtcaaagataattatctgtagttacatgagtgatactgtcttttaaaatgtcctcctttctgggttgtctgttttctcattgtatagattaatttgttttcctaagctacattatttgtaaactggaagttggatctagaagattagattcatcttaaacattttggcaagaatgtttcccagatgattgagcacttcaaattgtatcaggtcaggagatacacaatgatggattgattgtcctgctggtagtgatggtaaaaattgattaaggtggtaacctgcagattttcccattgtaatggtacattttgccatttgcaactagtaaataatctgtggggtgattctttggccatgaacacagaaatatttgactcaatatttgtcaggcatttgataggtactgggaagacagtggtgaaaaagagatttctactctcacataccttacctttttccctccagagtttgaagacaatagtgggaatggatctgtttttgcagcagggaacatttgcagtttaggatatgttcatatcagaaaaatagaatccatgaaaaggtatatgccagtgaatacagagttgtagtatgagatgatgaaaaaattcgggagatggatagtggtattgattgcataacaatatgaacatatttaatgctgctgaactatacacaaattcagctaaaatggtaaactttatgtgtatattaccacacacatgaaagtatatgtcactgtgatggcataccactgaatttagccctgcctcactgcctcttccctgataatttttatcaggcttcctgttggtctattaggactaattgggagaaaaactcttcctgaaataaaattctatagttcagttctgttaggaacaggcagtgatgttgtattttagcaattgccatcagtagagtttgtctttgtagcctcgagggatcattattgatgtctctgggtatgctgttgccatttgttgcagttcaccagatgctggcctgcctttgccggtttaggaagagattatagcttgaaccattgtctgaatgctgctttgacctagtaaatcctgggttcaggatgagagcagtaaccttaatgccagcaggaaagtgattttgtgaccagtttgttagggaggaagcccttcatttaagaaatagatcttctgggccgggtgcgatgttcacacctgtaatcccagcactttgggaggccaaggtgggtggatcatctgaggtcaggagtttgagaccagcccggccaacatggtgaaactccgtctctactaaaaatacaaaattagctgggtgtagtggcgcatacctataatctcaactactcaggaggctgaggcaggagaatcacttgaacctggaaggcagaggttgcagtgagccaagatagtgccattgcacgccagcctgggcaaaaagagtgaaactccatctcaaaaaaaacaacaaaaaaaaaatgagatagaccttctcattaataacaagagctagcggggcactgaggcatgtgcctgtagacccagctacttgggaagctgaggcaggagaattgcttgagcccaggagttcaagtccaatgtgagaaacagccagagcctgtctctaaaaataaataaataattaatgaacaaaaaatagcaaattagatggaaggaaagaacgcctttatttgtggctgacggagcttggacttctctttcctttcctttttgcctgagttaactgtggacaaggtggactagtggccaggcacagtaattcacacctgtattccccacactttgggaggccaagttgggaggattgcttgaggctaggagtttgagactaacttgagaacgcagtgtgatcctgtctctattaaaaatttttttaaattgaaaccaaaaacaaaagaaaaacaagactttagtgatggctgtgatgacagcatgatcatggtaaactgtgactttttcaatctatagaaattgtatccacgtgaaacctttgaattgtcttcactttggagagtatctagtgtatcacaaatgtttagttttcagtctacagatcataggttatgtgcaagcttttgcttagacagtagattaggaaaattagtatgttgtagtacagtgttttgcacagtttttaactgacctgtagcaggaaatacattttatattactacgtattactattatatgcatggatatatgtaactaacatgtttcaggaagtggtatttactcatagtgtgttttctgatttactcaaatttcatttaaaaaatacacactgttgtgacctaaattgatttttgtgactcatgctttaagatgatctggaaaagtggttctcaacatgtggtctggggatatacacaaggattcttttattaggggtttgtgaagtcaaaactattttcataacagtactattatttgtcttttttgctctcattctctaataagtgtagactttccagaagtatagtagaggtttctagaactatatcatgtgtgatgataatgctctcaggactaagggaatgtatatttgtatattctttattttctagagtttcctaaggtagtaggtttaatatataaatagatgctttttcagagattcaactcagttttcagtatttatattatgctcttagtagttgtctttggttatatctgcctaatctgtacctcactgtagtacagtgaattgttctggactactgttctgattctttactttgcctctcaggaatttccttccactaatgaataggctccctaagaaatataatgatggataaattatagtttattaaatcattttggtttatttggtaaatcttctgtttctcttggctgtatgaaattctagtgtaggtggcatatttttcaccagagtttctcttcttacatcccaataatacaagaaaatcatagcaataagtgccaaataaggtcaggtaaagttcatttaattcttattgcctgtaaatatataatgctcacttctcctgaagcacccactgagatttacagcaacacaggaaagtagatatgatttttattttattttatttgtatatattttttgagacagagtctcgttctgtcacccaggctggagtgcagtggcgtgacctcagctcactgcaaccttcatctcctgggttcaagtgattcttctgcctcagcctcccaagtagctggcatttataggcatgcgccaccacacccagctaacttttgtatttttagtagagatggggtttcactatgttggccagactggtctcgaactcctgacctcaagtgatccgcccgcctcggcctcccaaagtgctgggattacaggcatgagccaccgcgcccggcctgcgatttttagttttatttttttcctagacaaggtcttgctcttttgcccaggctagagtgcagtggtgtgatcattgttcactggaacctaaaattcctgggctcaaacagtctttccacctcagcttcccaagtagctgggactgtaggcatgtgccaccttgcccagctaatttaataaattttttagagatggggtctggcattgtgtccaagcaggtcaaactcctggcctcaagtgatcctcttgccccagcctcccaaagcgttgggattataggcttgagccaccaagcgtggccatgatttctttttcttaaagttaggaattgaactgtatcctacttttgttagttacttctcttctcctttagtttgttttcagccttctgccctagtcagactgatatccagaattttgctcttgcataacttcattgctactctgtcttctagcgctacactttcgtatttatgtttgaccttccttcaaactctcttgaaggatcagcagctgcataaccaactctaccacttagggcagggccttctcaaataacatcttgcagagatggccacttcatattaaatcggtggcaggatacagttgttgaatttcataaaatttcatccctaggattagacatttgatatgaagagatttagagatggaatcataaaagagttaattccaaaaggtatggacttggaaaattctatgacttggaatgataaagaaggacatttaatgccattggagaagaggcaagtatgacttatctctagccacttaggccattctttttgggacatacagttgatttccagtccaatgtagaatcatgttcaaaatcacaattgctgggccagatgccgtggctcacgcctgtaattccagcactttgggaggccaaggcaggcagatcatgaatgaggtcaagagatcgagatcatcctggccaacatggtgaaaccccgtgtctactaaaaatacaaaaattagctgggcgtggtggtgcgtacctgtaatcccagctactcgggaggttgcagcaggagaatcgcttgaacctgagagtcggaggttgcagtgagccgagatagcaccactgtactccagcctggtgacagagcgacactccatcttaaaaaaaaaaaaaaaaatcacagttgctgatattttttgagtatgtgctagatactttacatctttcatttaatcctcatacaaccctgtggaatggcttctgttattactagttaagtaggtcagacacagtgagaggctgaaccaggatttgaactctagaaacctggtctggaccctgccactactctatacagcctctttttatatataaggccacatttgcaaagtatttgtatatatgttttcatttaaacatcacagccatcctgtgcattaggtgacattcttgacattttcacatgagaaaatggaagcttagggaatttgaagctcaaagtggcagtgcctagacccagacctacttctgactctaatccatttgttcttctgattatgtagttttgctaaacatagtaaatataggttcatacctgaaagtgaatttttgatttcagatataagaattttagcttgattgaagatgatttcttaatgttttagatgggatacttaaatctggagaagtttaacagagatgtgattattaacttacatttttagtttctctggtggcttgtgtataactgttcattaagtgttgatcttgctattggcctttttttgttgttgttgtttttttgtagcgatgggacattgctcttttacccaggcttggtcttgaactcctagtttcaagtgatcctctaccatggcctcctaaagcactaggattacaggcatgagccatcacacttgactgctgttggactttttttttttggaaacgacatcttgctctgtcgcccaggctggagtgtagtggcacaatctcggctcacggcaacctccacctcccagggtcaagcgattcttctgcctcagcctcttgagtagctgggactggttattttttgtatttttagtggaggtggggtttcactatgtgggccaggctggtcttgaactcctgatctcaagtgatctacccacctcggcctcccaaagtgccgggattacatgtgtgagcaccgcgcctggcctgctattgtactttttaatgatgttagtcagtttaccactcttagagtaactttcttaggtaatttcagcgatgaagacatagttttctctgctttaactttagttggtgcagatggggtgactgaacacatagaaggaaagaggtcttgccaggactgtaatgtaatggtggtagtgggacgggtaggagtatatgtgtttgaagggagtaatttagaataccaacttttttttttttttgagaccgactttcactcttgttacccaggctggagtgcagtggcgcgatcttggctcaccgcatcctccaccttctgggttcaagcagttgtcctgcctcagccttcctgagtagctgggattacaggcatgcgccgccacacctggctaattttgtatttttagtagagacgaggtttctccatgctggtcaggctggtcttgaactcctgacctcagatgatctgcccacctcagcctcccaaagtgctgggattacaggtgtgagccaccgcacccagcttagaataccaactcttgatcttatgccagttccttctaaagcttctactcctagatgtgaaatttcataaatcttaagtttgacagtttgaaatagaggtcatttgttgattaagagactgacctttgtctatgaatcaaaacattaatcacagctccagagagaaggatcatgtaggaaagcttcctgatgagaggaatgtagcaaagctggaaaataggtgcatttatagactatcttctggtttcaagtgactgcttgctatctcccttaattcacttaaagacttaggagaaacagcatgtgtgacaaatttcatggtttttatcattaaccaagcaaagatctagagttagtgttttttaagacaagctgttctttcaggtttatagtaacctttcttgactggcaaaaagaaaggtcactcttacttcccctttagatttacggtcaacttttaggggttttttctttttccataacttcttatttgtataatactttcattaatccttatattctaggaactaaattggcatgaccagtaccatgtattatactgatgacttaacagttgcatcaattataaaaggtggtgaagaaactaggcattatctttgtttcccttttctgtgtttgttgatacagaaatcaggcagtaaacagaagtattcagggagtatttgtatttcagtaggtgtttcactggctaatgaaaatcaagttaaaaaattggttgactttcaggagaaacaatatttctctttttttttttttttttttgagacagtctcactctatcgcctaggctggagtgcagtggtgtgatctcggctcactgtaatctctccctcctgggttcaagtgattctcgtgcctcagcctcccaagtagctgggactataggcacatgccatcatgcccggctaattttcacattttttagtagagacaggattttgtcaggttggccaggctggtctcgaactcctgacctcaagtgatccgcccgccttggcctcctaaagtgttaggattacaggagtgagccacggtgcctggctgagaaactgaatatttctgagttatattattgtttccaatagtagtatttgtgtatgagggtggagtgggggtgctttaaagattacttcttgcccggcatggtggcataagacctgtagtcccagtaacttgagaggctgaggcaggaggatctcttgaagcaaggagttctgggctgtaatgcagtatacagatcaggtatctgtactaagtttggcatcaatatggtgacctcccagcaactggggaccaagaagggagtacactggttcaggttggaaactgagcaggtcaaaactcctgtgctgggctgagcgtggtgggtcatgtctgtaactccagcaatttggaaggccaaggcgggcggatcacttgaggtcaggagtttgagaccagcctggccaacgtggcgagacctcgtctctactaaaaatacaacaaattagccaggcgtggtggtgcacgcctgtaatcccagctattcaggaggctgaggcaggagaatcacttgaacctgggagacggaggttgcagtgaattgagatcataccattgcactccagcctaggcgacagagcgagactctgcctcaaaaaaaaattaaaaagtttaatattgcgagttactgcttttgttagcacccaaggagacaaatatatgcatattctagtaaaacctttggaaaaaccaagaatgtgccttagatataacatctaaactcagattgcttctcttcaagatgatgttgagatgccttatcctcatcttgaattgatagccacattttgttgttgttgttgcagagttgtgatgatatcatagttaaatgtgcagcaagcacactgaacagttgattatacctgatggtatgcaggaaggcaggcaacagtgatgggagagatctagcacttttaactcatttcttgaccaattagttttgtggagggcttgtttgtggtcagggtaagtgtatcccgactcttttaggatcattctgtatataagtagctatttgacactagttcttgggggaactttttagggaatagtttacttttgtatattcatcttctcttgaacattctgccttcacagctatctttttttttttccttaaaggtcctactgactaaatatttttttttaatcaagagacttaggtacgcataagcttcctgctaaattctgtagacaccttctatttatgggttacattatctggttgttggaattattgtgatctaacatttttcatgtatggaaactgttctatgtactgttgatctctgtagaatttgatcttttccagaatgtatttgaaggctgacctttcagtaaaagaaatgcaagcttttcagccatgttaatttatcactgcatcttctttgtaatatatatggcagttatgttaaaagtaaacatgtgtttttccttattctctgtgctcaggccatttatcatttagggacaaaaagttttatatagatcaaaagataaaaacttgggcctaaggcttagtcattgtaaggcagtgattccgactctttttatacttccttagggcattttaattaaaatccatcatgagatatgaaattatcaaactttgtataaccttttattttagaagaaagttttatatatatcttattaataaggagatactgataaatctagtaagtgaagagaaaccccctaaaatttgaagagatcactgctatagaggagcaacacagtctgtatctatggtctttggaacttggtagatgtccagtgaagttatgctgaatgaatcagcatttttcttatgtggcttcttaggtggagcttcccccaaaccctctgtgttagttgttcttcctactgggcttcaataacatttgtatctacctgtcttaatacatagcacattaaattgtaattctataatttatttacatatttgttgccccctagtggccagcaatcttcttgagtgctaggactacattttaatttttgtatacagagtgtctggctattttttctatattcagcatggtcttgtatgaattataatacacacacacacacacacacagtcttgtatgaattatacacacacacacacacacacacacacacacacacacacacacacacacacacacacacacacacacacacacacacacacacggtcggggggatagacagcaatgtccgtctatccacatatggcccagtgtgtgacctggcagcagtgctgggttttcaaaaggttgcaaagaagaaaatgaaagcaacagcgttttaaagttcagttgattttttggatatgtatgcattcatatgttgtgggagagcagagtgaaagcctgaggttgctttttcctttaaaatgtatttatttattcaagtacatattaaggctatgaagtggggatttggtatatgttgcaaagattcagatttaatccatgtagttttttttttttttttttttttgagatggagtctcactctgtcgcacaggctggagtgtagtggtgtgatctcagctcactgcaacctctgctgccggggttcaagcgattctcttgcctcagcctcctgagtagctgggatcacaggcgcctgccaccgcgcctggccaatttttgtatttttagtagagatggggtttcaacatcttggccaggctggccttgaactcctgacctcgtaatccacctgccttggcctcccaaaatgctgggattacaggcgtgagccactgcacccggcctaatccatgtagctttatataactttacaaaacaatgccctaaattttttttttttaaatcgtatcacagtgtgagacatgaaaatctaatagtgacaagattggtttctttctttctttctttttcttttttttttttttttgagatgaagtttcgctcctgttgcccaggctgaaatgcagtggcaccatctcggctcactgcaacctctgcctcccaggttcaagtgattctcgtgcctcagcctcctgagtagctgggattacgggcctgagccaccatacctggctaattgttttttggtagagaagggttttcaccatgttggccaggctgctcttgaactcctgaccttaggtgatcctcctgcctcagcctcccaaagtgctgagattataggcatgagccactgcgctcagcccatcacttggtttcttttttctttcttttttcttttttcttctctctctctctctccttctctctctctctctctctctctctcttttttttttttttttgagacggagtctcactctgtcactcaggctagagtacagtggcgagatctcggctcactgcaacctctgcctcctggatttaagtgagtctcctgcctcagcctcctgagtagctgggattacaggcacgtgccaccatggcaggctaatttttgtatttttagtagagatggggtttcaccatgctggccaggctggtctcgaactcctgacctcgtgatttgcccacctcggcctcccagagcgctgtgattactggcgtgagtcaccatgcctggcccacagtttcatctttttagaggtctataataaattataactacaaatataggaagtgagaacacattttcatggcatacacacaataaatgtaccgagttcaaacaccttgtgatagaaaatgctgattagaaatagcagtgttttcatttcagccagaatagttgaacaaccagtagtttgtcaacgaaaagctagaattagaaaccaggaatggtggaatattagataaacaataatatagctagaaatgtagtgtcccttaacaaatatcagaaatctcttaccccagggaagatcctttgctaatcctttatcctaccaagcatggggttttttttttttctttctttcttttttttttttttttttttttgagatggagtctcgctctgtcgcccaggctggagtgcagtggcgcgatctcagctcactgcaagctccgcctcctgggttcgcaccattctcctgcctgagcctcccgagtagctgggactgcaggcacctgctaccacaccgggctaatatttttgtatttttagtagaaacggggtttcaccatgttagccaggatggtctcgatctcctcacccagtgatccgcccgcctcagcctctgaaagtgctgggattacaggtgtgagccaccgcacctggcccaagcatggttttctgactaaaagacattctttgttgctgactggtcccaccactacaccttctctctctctgccagacccatttaagctgtatctgaggtcgtccttgacaatttcttccggttaccttaagagactggtctggtcgaagtctcaagtggatttttgtagcatagagtagtggttaggactgtcagctctagaaccaaagtacctgggttctagatcctagccacatcaattactagctttgtaacctgggcaagttacttctttcattttccttgctttggtaaagagggtattaatatctcatagggatgttggatttaaatatattaatacatgcatagtgcttgttacagtacctggcacatggtaggtacttaaacatttagactcctttgtgccttttggaatgggaattgcttaagctgtcctgaaaaaatagcctttaacatctgtttgattgagatttgtgatacatagaagttgagaggaagatgtggaaagccctaagagagctacttgccaaccccaccatcaggtctccctcagtgttcctagtcaggacagacgaggccgagtctgaaattagatagtctttgaatgcaacataaacagaccagagggactggtatgtagcaaattgtcaatatataatgtaaataggaatgaaattgaaatgatgtgagttggattcagagtgtagaagactttattttagaacataatggggccttaagttgtttacttccaagggaaagttgagatctgagaggttaaatgatttattaaactgcctatagttgcacagcaaagtaatagaaaaagtgacaccagatatattttccctttagacacatttgcttttttgttgtttttctgctattacccaaaaaggttagcttgggtcagctttacctttctgtttcttcatgtgtaaaataaatccatcattcgtcttaattctcacagtgtgattatcttaggcaagaaaaactatttgatacaaactaggtctcaaactcctggcctcaagtgatcctcgtgccttggcctcccagagtgctgggattacaggcatgtgccactgctcctggtcttggcatgcttactgaaaatcaattcactgtaagtgtaagagtttatgcctgcattctcctttctgttccatcaatctatatgtttctccttaaacaccagtaccacccagtcttgattactatatgtttatagtaagttttgaaattactatagttttatagtgagttcttcactcttcttttttctttggaggcaggatctcactctgttattcaggctgagttcagtggcgtgaacatggcttactgcagcctcaacctccgggactcaagccatccttctacctcagcctcctgtggagttgggactacaagcacacaccagcactcctggctaatatattttttttttgtagaggcagtggctggtcttgaactcctggattcaagtgatcctcctagctttcttttgttctctttaaggattgttttgactattctggtttgctggtatttccatatgaattttaggatcatcttgctaatttctgccaaaaagaaaaaaagctgtgattttgataagaattgctttgaattggaagataaatttgggagagtattgccatcttaataaggcctttcagttcatgaacacaggacatttttctatttagctaccatttaatttccttcaacaatgctttgtagctttctggtatataagtcttgtacttatcttgttaaatttattccttagttttttttatgctattataaatggattttttttcaacttcatcttgggattttttgttgctagtatatagaaatagaactgattttattagctcttatagttgtgtgtgtgtgtgtgtgtgtgtgtgtgtgtgtggattccttatagttttctgtgtacaagatcatgtaatttgtgaatagatgtagttttacttgttcctttccaaacttttctttttcttgcctaattgccatagctagaaatttcttgcctaactgccctagctagaaacttcaatacagttttgaatagaagtggggaataaacatatctttgtcttgttcctaatcttagggggagagctttcagtctttcaccattaagtatgtttttctcttttttttatttttgaggcagagcaagaccacatctcaaaaaagaaaagaaaaaaattatggaatatttatagacataatgtgatgcactggtttttatttttatttttttttgagacaaggtctctcaccctgtcacccaggctggagtgcagtggtgctgtaacagttcactgcagcttggacctctccaggcttaggagatcctcccacctcagttttttgtttgtttgtttgtttgtttttcttttgaaacagagtttcttgttgcccaggctagagtgcagtggcgcgatctcagcacactgcaacctctgcctcgcgggttcaagcaattctcctgcctcagcctcccaagtagctgggattccaggcatgcgccaccatgcgtggctaatttcgtatttttagtagagacggggtttctccgtgttgatcaggctggtcttgaactccctacctcaggtgatccgcccgccttggcctcccaaagtgtggggattacatgcgtgagccaccgttcttggcctaatttttgtatttttagtagagaaggggttttgcaatattggccaggctggtctccagctcctgacctcaatgatcagcctgttttggcctcccattgtgctgggattacaggtgtgagccaccatgcccagccagtttttgtatttttagaagagacaggttttgccatgaaccaggctggtcttgaattcctgggccaaagtcatctgcccgccctggcctcccagagtgctaagattacaggtgtgagccactgcacttagcctggtttttatttttattatttttctttttatttatttattttgaggcaaggtctggctctgctgcccagactggagtgcagtagccccatcataactcatggcagcctcaagctcctgagctcaaacaatcctgctgtcccagtctcctgagtagtacaggcgcacattaccatgctcaactaatttaaacaattttttttttttataagatagggtcttggtatgttgcccaggctggtcttgagctcctggcttcagaaagtgatcctcctaccccagcctccctaattgctggtattacaggcatgagccaccatgcccactttgggaggccacggcaggcaaatcacctgaagtcaggagttcgagaccagcctggtcagcatgtcgaaaccttgtctcttctaaaaatacaaaaattagctggatgtggtggcatgtgccagtaatcccagctacttgggaggctgaggcaggagaattgcttgaacctgggagacagaggttgcagtaagctgagattgcgccactgcactccagcctgggcgacagagtaagactctgtctcaaaaaaaagaaagaaaccgtttcctaaaaacagtctctctcagcttattctagttttctggataactcagacatattgttactgactcagtgaatattctctgctcaaaagttctgatttcccaactcttacctgcttttttactttttaaatgtctgacatagacagtttgagaaaataccctttccactattctattttctggcagctttagaaaagaatgtcagaaatttctatagaatgattaatagatgaatacctacttgcatctagtgttgcttcctcatatttcttctgctcaccacctaggagagtgatacaactaatactcctgcagtttgacttaactaccagtacttgagttaatctaagtattccatttatgtggccattttaaccactttatatagttaattacgactaaactgggaatggtgaatattttttaagacatttaaaattcttcatattatttggattctaaataacatgattttgctatattatttggtcatctaagtagaataaagtaatttgttgttggttattcaggaatacaattccctgttaaccctgggaaatgcaaattgcttttgagaggaaatatggttgaaatgatgtcattgttcagtttatacttgttacttactgtgacactgggcctagtgaggactggtacctacagaaagccagtaactccctttaggctgctaaaatcacgtatatgaaaagcatctagaataaaagcatagcatgctagtaagccaatttgtattatttggtaatgttgatgggctagaggaaatcagtagctgatttccttactgttaaagtggccttaccttttgagtttcacctatagcagagattgtgttattgcctactgatatccagggttactgtgaggattgaatgtttttaaagcatttatgagatatgttatagaagcttactttgactagggtttacattaagataggatacaggaaaaacagacatccttgacagtgttaaaattcacacaggccaggtgtggtggctcacacctgtaatcccagcactttgggaggccaaggttggaggatcacttgagcccaggaggtcaagggtcaaggctacagtgagctgtgatcgtgccactgcaccccagcctagatgacagagactctgtctccgaaaaaaaccagcacacacacacgtaattttcacactgttgccaactttccagttgcaataatcaaaaagagatcaggaattcaaattcatttttctgttgtctttaataaatgggaatggcttggagacagaagccttccttgtatccttacattctccctattgaaggtgtaaatggaagaatttaaggagaagaaaagcatgaaaaagatcaggggaactttttgcctatcatattagaaatgttgggataatcaagatgattactttctcctgagtgaagaagaatccgttatggtagacctaataaaaaggttgaggtttgaaaacatgagggatttttaaaacaagcatattagaactaaaaatgcaagtgagtgctttctaaaagtgattctgggaaactatacttattctagtagcattgctcttgctttataatgtgcttggaactcatcttttctagttcttcagagacacatatacaaaataaggtgagggagagaactggatgatgtttttggggaaaacaatgttaggaattgtcagtgaacaccctgccctgcaccaaaagatacctaaaaatactttgaatgatgatggcattattggtgtcagtgaagtcttatcaaaattaaaccttcttttggcttttgaactgtgatttgtggcagccaagttactaggtaagagagtgttctaaggctttttactaaatatggaaaagatactagatttcccttttgtgtttttgcctaaaacttgtaagttgaatcttgctttcctctggtatgtaatagtcaagtttatttctttcattttttatgacttatttctgccctttcacagacttctactccctaagagacctatctccagtgtctcattttcttacgtgtttatgtagattcaggtgctatgtaatcaattctagatcatcaatacttagttttaaattctagatttgatgttcttagcacagataaaggtagagtgactttatccttaccactaccactggcacatccagtttcctgttgggtatgtattcaataaatttcagcaaattttaacactggctaaagtaaaataccatcattcattgcttaacaatggggatatgttctgagaagtgtataggcaatttcatcattgtactaacaatctagagtgtacttacacaaacctgggtggtatagcctactacgcacctaggttatatggtatatcctatagcttctaggctacaaatctgtacagcatgttacagtactgaatactataggcagttatagcatgccagtaaatatttgtgtatctaaacatagaaaaggtacagtgaaaatatggtataaaaggcaaaaaaaatggtatacctgtatagggcacttcttgtgatgggttttgcaggactgaaagttgctctaagtgagtcagtgagtgaatagtgagtaaatgcgagggcctaagacacttttgtagattttatgaacagtgttttattttttaatttataaaattttttttttcaataataaactaggctgggcacggtggctcacgcctgtaatcccagcactttgggaggctgaggtgggcggatcacctgaggtcaggggttcaagaccagcctggccaacatggcgaaaccctgtctctacaaaaatacaaaaattagccgggcatattactcgggaggctgaggcgagagaatcccagctactcgggaggctgaggcgagagaatcacttgaacccgggaggtggaggttgcagagagccgagatcactccattgcactccagcctgggcaacagagcaagactccgtctcaaaaaaatattactactactagtaataaaactaagcttagtctgtaactttttaactttatatacttttgaacattttctaattttccacttttgtaataatacttagcttaaaacacagatacattataccacgtacaaaagcattttctttatatccttattctataagcttttgtctactaaagttttttttttaactttttaaacttttttgttaaaaaccaagacataaacatacacatcagcctgcagagggtcggggtcatcagtatcacagagcggcatcattatcactgtcttccgcctccacatcttttcccactggaagatcttcaggcacagtaacacagatgagctgtcatctcctgtgataacaatgccttcttttggatacctcctaagagacctccctgaggctgttttacagttaatattaagaaaaaaaaaagtagaaggaatgcatgctaaaataatgatcaagcacagaataataaatacataaaccggtacacagtcatttattatgtactattcctaacagtatgtgctacacttttacatgactggcagcacagttagatttacacaagcattgccacaaacgagagtaatgtgttgtgctatgatgtcctgatggcaacagtgtcactaagagataagcattttttagttctactgtaatctcatgggaacactgtcatatatgtgcagttcatatatattgactgaaatgtcattatactgtgcatgactgtattaaaaggtaaacttgcagtataagcaacattttgaaagtgactgcttattagatagaattctcataccatacagtctcctcatttaaagtgtacaagtcagctgggtatagtgactgaagcctgtaatcccagcagtttggaaggctgaggcgtgcagatcgcttgagcacaggagttcgagaccagcctggccaacatgggaaacccctgtctctactaaaaataaaaaaatcagctgggtgtggtggtgtgcactggtggtgtcagctatgggaggctgtaggtgggaggatcacctgagcctaggaggttgaggttgcagtgagccttagtggagccactgcattccagcctgcgcgacagagcacaaccccatctcagaaaataaaaaataaaataaagtgtacaatccagtggtttttagtatattcacagggtcatacaaataccactatctaattccagaacattttcattgctcttgaaaaaacccatactattaacagtcacttctcccattcttcattttctctagcccctggcaactatgaatctagtttctgtctctatggatttgcctattctagacattttatttaaatgaagtcatacaatatgtggtcttttatgactggctttttttttatttggcataatgttttcagagtttatctatgtcatggcacatagcgttatttcattcctttttgtggttaaatgatatctcattgtataggtataccacattttgttaatgcattcatcaattgattgacatttgggtggtttctatcttttggctgttgtgaataacactagtgtaaacatttgtgtataagcttttgttttgaaaagaagaacgtatgttttcagttctttgggttatatacctaggagcagaattgttaagtcgtacgataactttgtttaactttttgagaaactttcaaactgtttaccagtgtctgcaccattttacattcccaccagcaatgtatgaggcttccagttggtctgcattcacatcagcacttgttattgtttatctctttgatgatagccgttctggtgggtataaagtggtatttcattgtggtttttggtttgcatttttctaatgactaatgagaattgagcatttttcatgtgcttattgtacatttgtatatcttctttggaaagacatgttatctttaaaactaaatattgatggtgtgctatttggaatgctgggttttttttgttttgttttgttttgtttttttgagacgaagttttgctcttgttgcccaggctggaatgcaatggcacgatcttggctcactgcaacctccacctcccaggttcaagcgattctcctgcgtcagcctcctgagtagctgggattacaggcatgtgccactacgcccagcttattttgtatttttagtagagacatggtttctccgtgttggtcaggctggtctctaatctcgaactcccgacctcaggtgatccgcctgcctctgcttcccaaagtactgggattacaggcgtgagccaccgcacccggcctggaatgctgttatttagattaactttcttcctttatctgagacaagggtttttgatccattcattcaaatgtgtttttgagattgctttaccaagctaattttaaatacagctctccctgtgaaaaaattatattttgtatcctggcttgaaatttctatgaagacagtttgtgcccactctgataaacagtgatagacaaatgaaatatttagtagaccctctttggtcctgtttttattgtgaatttatatctctaggctcaaagaattagcaagggtaaaattcatagaggacccagtggctcattgaaacttcattatattctgtggattctgagaatatcagctatcttgagagaaagaaaagatccataaggcaaggaaaatagcaactgagtttgaaagtagcactttgcacatgtagggaaatctatgaccacttgtaggtaggcatgaaaaagtgcatgatttcatcagtatgttcctttctttcctagcgtggtaccatgcgacgacgctatgaagatgatggcatttcagatgatgaaattgaaggaaaaagaacttttgacttggaagagaaactgcacaccaacaaatataatgccaattttgttacttttatggaaggaaaaggtcagtattgttttggttccagcttacagtcctttgatgtgggaagccatagactctgagcattgggggtttagcctttatccagctaaaatattgcctgttgatgttatctatctattttctcttgttatacaatgccatttgcatgcacttatcccccagtcctcccaccctgtgagtcattctctcctatattagaagtaatctttttattagggcaggagtattgttggatttttttgcctaacggcctcttcctccttcttctatcccttggtttaaatttaattaaaaatagtacaatagaaatccttttatgtatatatctaccccaccaaaactgagggtgggattccatgcgcaccgtgcatctttgatccttggcaaactgacaaggatgtcatatatgtattgtagtggtcaaaattaatgttttgtttacttttttttttggagacggagtcttgctgtgtcacccagggtggagtgcagtggtgcgatctcggctcactgcaacctccgtctcctaggttgaagcaattctcctacctcagcctcctgagtagctgggattacaggcacgtgccaccacacccggctaattttttttttttttatacttttagtagagacggggtttcgccatgttggccaggctggtctcgaactcctgacctgaggtgatctgcccaccttggcctcccaaagtgctgggattacaggtatgagccaccacacctggcccttttttttttttttttaactcttcagagacagggtgatgataatttctgtttagcatttataagatgactcactattagtagtcctatccccatattatttaagctctaaatttcctgtggaaatttagacttggaatatagacttggaaaacccctcaagcgttgcttctcaatgtgctctccatattttctaagagatgcttcttactaagcatatattttattgactaacagcataactatatacacagaataacaaacaccatttatactgtattacttaggatcctttttatggtccttttatcgtttttaattataccacttatctttctaatattttcctatggtgacagattttaatgtagagtatattcagcggggtggcttgagagatcctctgattttcaagaattctgatggactcggaataaagtaagtgttttcagcctggctggatgtagttgcaaaatggcctcgttacacccagggcaataaacagtggtggtattgataacccaaaacaatagtaattgaaaataatttcccactttgttttaaaagtatatgcttttcttttgatacacaagtgtttcatattagaggtaaatgagaaaatatagatgaaccaaaaaaaaaaaaacaacaaatttaaatctcctgaaatctaccacccttaggtagatcattaacattttattatgtattcttttttcctgtgcatatgtgtaaatatataatcacctatatttttaaaataatttcaaacctgattgtgaatattactgtgtctggggagtactcagtactttaagaaaaaaaactcacatttactagagcaattgtgttttccatatatacttactggtgtttgtttcatagaatgccggatccagacttcactgtgaatgatgtcaaaatgtgtgtgggtaagtgtcgagcttttggcctctgtctttaaggcaaagatttaagacttaggactgaattaaatctctgactgagatttaaggcctaggaacattgaagtatatatttgattagaaactacattttcattaggaactgagaattttatcaaagagagttacagaagttgccttatttaatacacattaaacctagaaagttggaacctctttttcctaccttcatacttccttctctccttgaagagtgtgccttctagggcaacctttccaagaaaccgaaaacttacatctcttagccaagaaagaagtttcattaatatccgtgattcccttccttcccctaaaaggagtagagaaatttccaggaaatgctcgccagtgctgcatttggaaacttgcctaagacttgaaactttataggctgagaagtagatacattaaaattgagtcttttaattattttattatattcaaaatttgggaaaaagaaagcaaattaatctaattaaagaagaaaattcctgatgttagtaaagtttcagcctagttttctgcagacagtggtgttcattgtggtcctgagacacctcagcatccttaggagttcagggatggtcagtaaaattgaataagtcttttttttttttttttttttgagacgcagtctccctctgtcgcccaggctggagtgcagtggcacaatctcggctcactgcaacctccgcctgctgcattcgagcagttctcccacctcagcctcccgagtagctgggattgcaggcatgtgccaccaggcccggctaatttttgtatttttagtagagttgtggtttcaccatgttggctaggctggtcttgaactcctgacctcaagcaatccgcctgccttggcctcccaaagtgctgggattacaggtgtgagccactgcacccggctggaataaagtctttttgaaatgcgtccaataggacttaaaacaaagggactttttaaattttcttcctagcactagaatttctattatcttttgtcctctgtactaaagctccagtgccattcctttgctttgaaaattaagtactgcagtactatctcctggccacttgtgggtccttgttagactaccgactcttctgttcatctaaaacgtgaaagtcacagatatcccaggtagaggaaagttcccaaatctctgttttattcatccccttactgtttctgttttaaaccctggccatctgcctgttgccatgtattccttagtacctagcacagtccctggaatatagtaggtgctcagtaaatccgttgaataatgaaaatgctcccctactcgtcacaagacagaacactcaggggacctcagaaaacctacctgaatatgtaatagtctgtaatttgacctcttttattaaagagcctccaggacagtaattccctgtttaaagcttccctcttgatgagacattcttacagattgtggtccacagatgacctgcatcagaattgcttgtgatattgttaaaaatatagactctcagagaggattgtaggaagatggcagagtagcaagcaccaggaacttttctccttacctagacaataattgcacgggcagaatctgtctgatacaactattttggagttcaggagtctattgaaggcttgcaaatttcagggacagcttggacaataaagtacagttaatttcagtcagtttcaggccttagcacagtaacagctgctccattcttccctgccaaccaagcccatgacaagcagctgtgcatatgtttccccgaaaaacttgcacacagcttataggagccagggtgagcaaagaggaacctttcctccaaataatgggatccatgctgtggtcactgagtgctgcttctgatcacagaagtacagacaaagaggcaggtggggccaggcacagtgggtcatgcctgtaatcttagcactctgggaggctgaggcaggtggattgcttgagtccaggagtttgagatcagcctgggcaacatagcaagaccctgtctctacaaaaaatacaaaaattagctgggtgtggtggcatgcaccaatagtcccagctacgtggggggcaattccttgagccctggaggctgagactgcagtgatatgtgatcacaccactgcactccagcctgggcaacagagtgagaccctgtctcaaaaaaaaaaaaaaaaaaggcaggtggggcagttgttgttgcatcttctcctaattgttgcaggcctcttcccctcagctgaactgacttccaggggatttaaagggctattgtggccgggtgcagtggctcatgtctgtaatcccagcactttgggaggctgaggcaggagggtcacttgaggtcaggagtttgagatcagcctggccaacatggggaaactccatctctactaaaaatacaaaaattaggccgggtgcggtggttgacgcctgtaatcccagcactttgggaggccgaggcgggcatatcacgaggtcaggagttcgagaccagcctgaccaacatggtgaaaccccgtctttactaaaaatacaaaaattagctgggcgtggtggtgggcgcctgtaatcccagctactcaggaggctgaggcaggagaattgcttgaaccgggaggcagaggttgcagtgagcgaagcttgtgccactgcactccagcctgggtgacagagcgagactcatctcaaaaaaaggtgagtggagggtggctattgcccacacccacccccattttagttttctcttttcccctttaagagccagacattaaagactagcacattcagaataggaagcgactgcatatgcacatggacggtcaggctcagagaagacgtaagaaaacttaagtgtatacctcagattgatccttgacacagagatagcctataaaaaacaaaacaaaaacaaaacacacaataataaaacacaaaaaaccctggggaagggagagaattggatttcaagagttaccacattattaaattcaaatgtccaattttcaacaaaaaatcataaggcatacgaagaaaaaggaaagtatggcccattcaaaggaaaaaaatcaacagaaaatgtctttgaaaaagtcctgattgtggatctaatagacaaagatttttaaatagctgtcttaaagatgctcagaaaactaaggaatatgtggaggaagtcaaggaagtaatgtatgaacaaaatggaaatatcaataaagagacagaaaaccttaaaaggaaattctggagctgaaaagtacaataattaaaatgaaaacttagattcaaaggcagatttgaacaagcaaaagaatcagcaaagataggacaatggagattattaagtctaaggaacagaatgacaaaaattgaagaaaagtgaacatagcttgctataggttaaatgttatccctgccaggtgtggtgcctcacacctgtaatcccagcactttgggaggccaaggcgggtggatcacttgaggtcaggagtttgagaccagcctgcccaacatgaaaccctgtctctactgaaaatacaaaacttaactgggcatggtggtgggcccctgtaatcccagctacttgggagggctcaggtaggagaatttattgaacccgggaggtggaggttgcagtgagacaaggtcacaccattgactcccttgcactctagccttggtgacgagcgaaactctgtcgcaaaaaaaaaaaaaaagttatcccttccaaaatttatgttgaaattgaattgccattgtgacagtattaagcagtgggatctttaagagataattaggctacagggactccactctcatgggtgggattggtgctgttataaaagcatgagttcggccccttcgtgctttctctcattctcttactgtctcgcttttcaccatgtgatgatgcagcaaaaaggccctcaccagatgctggcgccttgattttagacttcccagcctccagaactgtgagcgaataaatttctgttcatcataaattacctactcaggttttctgtcaacagcaacacaaaatggactaagagcctaaaggaacattttgacaccactaagcagaccaacatacacattatagaagtaccagaaggaaaatagaaaggagcagagagaatatatatttgatcaaataatggctgaaaatttcccaaatttgatgaaagacaggagtataaacatccaaacagctcaatgaactccaagtaagatgaactcagagaccctcaccaagacacattataatcaaactttcaaaagccaaagacaaactcttgaaagcatcaagagagaaatgactaaatgattcattacataaaggtatcctcagtaaaattatgaacgaatttctcatcagaaactttggaggccaggaggcagtgagccagtgtattcaaagtgctaaaaggaaaacaaaacaaaactgtcaaccaagcatcctatatctggcaaaactgtccttcaaaaggggcgagagattaagacattctcagaaaaacaaaagctaaggaaacttgttaccactggacctgccttgtaagaaatgctcaggagagtctgcaaggtgaaatgaaaggacattagattgtaacttgaagccatatgaagaaatatctcgataaaggtaaatacatgggtaattgtaagagctagtattatcttaacaatggcttttaactcctttttgttttctccatagtttaagagacgagcatattttttaaaagacagttgttagcctaaaatctaatactgaaactttgagtgtagccccacattttattttgtacataatttgagagatcaatacatttaaaataattagtagaacggggtatagtggtatatgcctgtaatcccagctactcagtaggctgaggtgggaggattgcttgaacccaggaattcaagaccagcctgggcaacatagcaaagacccatttcttccaccccatgaatgaatgaatgagttattaatttaagtttaagggcaaaagctaataactaataggggcacagtatataaggatgtggttttgtgacatcagtaaccaaaaggggtagagacagagctgtaaaggagcagattctttgaatagtagtgaagtcaaactggtattaattaaaaatagaatttaacttcaggatattagatgtaatccctatgataaccataaagacaagatctatagtatatatacagaaggaaatgagaaaggaatttacacatttcaccaaataaatgtatctaagtacaaaagaaaacagtaatttaggaaaatgaggaacaaagctataaggatatagaagtcaaataccaaaatgacagaagtatgttcctccttacaagtactttaaatataagtggattaaattccccaatcaaaagacaagaaattggcagaatggataaaaatggcatgacacaactatatgctgtccacaagagactcactaaagatccaaaagacagaaatagattgaaagtgaaaggatggaaaaagctattccatgcaaacagtaaccaaaagagcaggggtagctatacttatatcagataaaacagacatttattaatttatttaattgattttatttatttatttatttatttatttatttatttatttattttgagatgacgtcttgctctgttgccaaggctggtgtgcagtggtgcagtctcgactcactgcaacctctgtctcctggttcaagcgattctcctgcctcagcctcccaagtagctggatttacaggtgcccgccaccacgcccggctaaattttgtatttttagtagagacggggttttgccatgttggccaggctggtcacaaactcccagcctcaagcgatctgcccacctgggccttccaaggtgctggggattataggcgtgagccatggcaccgggccctaaaacagaccttaaatcaaagaatggttccaagaggggcctggtatggtgcctcacacctaaaatcccagcactttgggaggctgaggcaggactgcttgaagccaggaattcagagaccagcctgggcaacataccaagacctcatgtctataaaaaaaataataatagtaattttaaaagttggctgggcatggtgttgcatgcctgtgctcctagccacttggaaggcttgagcccaggagtttgaggctgttctgatcacaccactgtagtccagcctgggtgacagagccaagaccctgtgtcttgaaagaaagaggctgggcgcagtgactcacgcttgtaatcccagcacttgccttgggaggccgaggcaggcagatcacaaggtcaggagatcgagaccatcctggctaacacggtgaaaccccgtctctactaaaaatacaaaatattagccgggtgtggtggcaggcgcctgtagtcccagcgactcgggaggctgaggcaggagaatggcgtgaacccgggaggtagagcttgcactgagctgagatcgcgccactgcactccagcctgggcgacagagcaagactctgtctcaaaaaaaaaaaaaaagaaagaaaaaatggttgggcatggtgcctcacacgtctgtaatcccaactttgggaggccaaggcgggaagattgcttaagcccaggagtttgagactaccctgggtaacgtggtgagacctcgtctctaccaaaaaaataaaaataatccaagcatggtggcacatgcctgtagtctaagctactcaggaagctgaggtgggagtgtcacttgagcctggcaggtcaaagctgcagtgacctgagattgtgccacttcactccagcctgggtgacagagcaagacactgtctcaaaaaaaaaaaaaaaaaaaatgtttcaagaggcaaagacatatattaattaaaggtttaactatagcaagaagatataacaattacaaacatttatgtacctaacgacagaccatcagtatacccaaaggaaaacctgacagaactgaagggagaagtagacatttctatacagtaatacctggagacttcagtaccccctctcaataatggatagaacaaccagacagaaaataagtaaggaaatagtggacttaacacagtaaaccaactagatctcacagacacagacagaatcctacctaacagcaatagcatacacattcttttcaagtgtatgtaggacattttccaggatacaccatatgttaggctacagattaaatatcagtggatttaaaaaatagatatcaaagtatcttctccaaccacaatgggatgaagttaaaaatcaataacaggtaaaactggaaaggtcacaaaattgtggaatttaacaatcagtgaatcaaagaagaaatcacatggaaattagaaaatacttatagatgaatgaacacaacacagcctaccaaaacttatagggatcagtgaaagcaacattaaaggagaaatttgtagctataaatgctttgattataaaacacggaatcactgattgcagtagcatgtgcctatagttccagctacttgggagactgaggcaggaggattgcttgagcccaggattttgaggccagcttgggcaacatagcaagaccttatctcggccgggcgaggtggctcacgcctgtaatcctagcactttggcaggctgaggccggtggatcacctgaggtcaggagttcgagaccagcctggtcaacatggcgaaaccccatctctactaaaaatacaaacattagccaggcatgatggtggacacctgtagtcccagctactcgggaggctgaggcaggagaatcacttgaacctgggaagcggaggttgcagtgagccaagatcgcacattgcactccagccggggcaacaaagtgagactctgtgtcaaaaaacaaacaaacaccagtctctttaacaaaagaagagaaacttaaaatcaacaacctaaccttacaacttaaataactagaaaaaggacaaactaaacctaaagctaaaggaagtaataaagattagagataaatgaaataaagaatagaaaaacaatagagaaaagtcaaagaaaccaaaaggtggttcttctttgaaaagataaacaaaattgacaaagctttatttagccagatggactaaggaaagaaagatcgaattactaaaatcagaagtgaaagtgagggccgagcgcggtggctgacacctataatcccagcactttgggaggccgaggcgggtggatcacctgaggtgaggagttcgagactagcctggccaatgtgatgaaaccctgtctctactaaaaatacataaattagctggatgtggtggtacatgcctgtaatcccagctactcaggaggctgaggcaggagaatggcttgaacctaggaagcagaggttgcagcgagccaagattgcaccactgcactccagcctgggtgacaagagcaaacctccgactcaaaaaaagaaagtgaaagtgaggacattacttccaattctgtagaaataaaaaggattgtaagagaatactatgcgtggtggctcattccagtaatcctagcactttgggaagccaaggtgggtgcattgcctgagctcaggagtttgagaccatcctgggcaacatggtgaaaccctgtctctactgaaaatacaaaaactgagctggacatggttgcatgttcctgtaatcccagctactcaggaggctgagtcatgagaatcgcttgaactgaggaggcggaggttacagtgagcccagattgtgccattgtactccagcctaggcaacagagcgagactctttaaaaaaaaaaatactacgaacaattgttcatcaataaattggataacctagatgaagtgtacaaatttctagaaacacaaaacttgttaagactaaatcactaagaaatagaaaatttgaatagaactatattgtagttagtgaggagattgagtcaatattcaaaaatctcccaacgaagaaaaggctgggcctgatggctttggtggtgaattctaccaaacatttaaagaggaactaacaccaattcttctcaaacttttccaaagaatttaagagggaacacttcttttttttctttttttgagatgagtctcgttgctgtcgccaggctggaatgcagtggcgcgatctcggctcactgcaatctccacctcctgggttcaagcgattccctgcctcagcctcccaagtagctgggattatgcccggctaattttttgtattttagtagagatggggtttcaccatgttggccaggatggtctcgatctcctgacctcgtgatctgctcgcctcggcctcccaaagtgctgagataacaggcgtgagccactgcgcccgaccaagggaacacttcttaagtctttctgtgaggccagcattaccctgataccaaagcgagacaaagacagtacaagaaaactacaaatcaatatcctttttgaacaatgatgtaaaactcctcaacaaaatacttgcatactaaattcagcagcatattaaaaggattatacaccatgaccaagtgggatttattcctggaatagatgatttgacatgtgaaaatcaatcaatataaatttcattaacagtgaaggaggaaaaaagttacatgatcatctcaattgacacagagaaggtatttgacaaaattcaacaccttttcatgataaaaacacttaacaaactagaaataaaaggaaactaccttaacataataaaagctttatatgaaaaaccctcagtaaatatcatactcagtggtgaaacaccaaaagcatttaagatcaggaacagcgtaaaggcgcctgcttttactgcctctattcaatgtagcactggaagtcctaacagagcaattaggcaaaaaaaggaaagaaaaggcatacaaattgtaaaggaagaagtaaagtcacctctgttggcagatgatatgacttttttatttgttattagtatttttctttggttccttctatcatgtgcatctttacacttagttttgctgtttgtcaaatatttcaaatatacataaaattacggagaatatcattaacaaaatgaacacccatctataaacccaaaatgaagatccacttgtgtacaacttagtaagaaattaaccttttgccatatttacttcatctctttttgcagaagtttgttagcattgacatccactgtgtaccattcttcccattttcaatcccttttccttcctcctctctccagagataggcactcccttggtttttaatgcagtctgtagacatgcatattgctttgcatgtttttaaacattaacaaatggcatcatagtgtacaaatcattctgcaacttgctttttcactaaacattgcattcattttaactaccatatagaattccattgtatgaatataccataatttacccattccccaccaatggacatttactttgtttccatttcttttttttttttttttttttttttttttgagatggagcatctctcttggtgccctgactggagtgcagtggcgtgatcttggctcactgcaacctccacctcccaggttcaagcgattctcctgcctcagcctcccgagtagctgggattacaggcatgcaacaccatgcctggtcaattttgtattttttagtacagatggggtttcaccatgttgggcaggctggtctcaaactcctgacctcaagtgatccatccgccttggcctcccaaagtgctaggattacaggcatgagccaccgtgcctggcctccatttcttgtcttacaaataatgctacaatgaaggtttataaatttcttcttgggtacacatttgagagtttagacggtataagcctagaagtgggccaaagagtatacattttcaccttgtcaaattcctctccaaagtgattgtaccagtttacactttgttgagtcaagtaggagagtgtcctttgttccatattcactcaaatacttgatattatgagatattcatttattttttatttttattttttggctagggggtatcagagtctcactttgtttctcagtctggagtgcagtgccgcgatctcggcttactgcaacctccgcctcccaggttcaagtgattctcctgcctcagcctcctgagtagctggaattacaggctcttgccaccacacccggctcatttttgtatttttagtataggcagggttttgccatgttggccaggctgatcttgaactcctgacctcaggtgatccacccgcctcagcctcccaaagtgctgggattacaggcgtgagccaccgcacctggccgagacttaaactttcaacaatctgatgggtatgaaagagaaacttgtagtttttaatctgcatgtcctgtaaggataatcatgttctcagaaatgtttattgactatttgggccatctatttaaattttttaaactttcatgttcccttttattctgttatcactttctcatagtgattaatagtagaaactctagttttaaaagttaatacacataaagtgctcagaagagtcacagccatgttgttggagacagtattatttttatccttttaaatacgtatatattggctgggcatggtggctcacgcctgtaatcccggcactttgggaggctgaggcagacagatcacctgaggtcgggagttcgagaccagcctgaccaacatggcaaaacgccgtatctactaaaaatacaaaaattagccaggcatggtggcaggcgcctctactcccaactacttgggaggctgaggcagaagaactgcttgaacccaggagcgggaggttgcggtaagctgagaccatgtcgttgtattccagcctgggcaacagagtgagaccccatctcaatacatacatacatacatacgtatttattgagacaggggtctcgctgtgttgaagaagctggtctctagccccaggcctcaagctgtcctcctgtcttggcctcccaaattgctgagattataggcgtaatctcactgcacctgtccaccattttagatactaatcttgccaaagttatttttaaaatttaatctcatttctttgagtgtttctacttatattttctaatcttttatgataaattatttcagcaattttagcattcatgactttaatccttttgtttcttttctagtattagtttaaaatgttccatttctgttctctttgtgtatctcagttcttgcttcaatgacagcaaataaaaatcctggtcttgtggaacagctgagtagtacatcctttcccaaactgggggagggtggttgctttacccccagctgtcccagcagctgctcagccagattcccagatctagcatctttcaaaacatctcaaccttggtaactcagataaaagtctttctgaggcgtaggtcctcctgtgtcaatggcacatctgaattactaacaacgtgttcttttcttaagttatgttatctagtcagttgatcaggagttatatatactgtggaccctgaaaacattatccctgcattattgagtaaatcatgtaaatactgcgagaaggtaaaaaacaccacaaaagcaatgtggcataacactttgtgcattacataggcacccaatacatattggtgattgcctagtaaaaaatagagggctctcagtgctgcttacctgcctctaataaaaatgtaggtggtattaaaccacaagctagaccatcaggaaggaggtacaaggatagatccacaacctgctcttggcctttatctcagcaagctacctggcttctgtactcctactttgattcacctgctgttgcagcagggttttaggaggatcctatttgtgtatctaagattcaacattcatgaaggagcagaaatacttggatttgcctcttagctcttggagctggagagtggatgacttcctgcaaggcacgatttttggattggcttctcaattattacaggaatcctcaacttttagaattgccagcctattcatctgatcttgaaagtgtacaaacttaccttcaaacagtgtagaatatatgcaattctggacctagacagaggcaataacctaaagacatttgcagctcatttcttgtcagaacccattgagaatagtggtattgatggaagactgtcaagcccatccagttctctagtctaaatagtctcagtttatccatgacttgagccatctaaaagttgcataacaaattagccgggcgtggtggcgcatgcctatagtcccagctacccgagaggctaaggcaggagaatcacttgaacccagaaggcgaaggctgcagtgagccgagatcgcaccactgcactccagcctgggtgatcgagtgagactccgtctccaaaaaaaaaaaaaaaaaaaaaaaaagttgaataacattaatacagcaatattcttcaaggtggttggattgctggtgatttttattttctttttaaactcttctattttccaaattttatgccatgggactgtgttctaaactgtccagtatgaagaaaacaaagagctctgttactataaagaaaatggttttcaggtctctattcagtggctctggtgtaatagagctgtatcaagtctttctttgcaaaactctttatttccttttatttttattagttgttcatgctctatgcagtctgtataaccttgggttttaaattcttcaagcaaattgcagttttctgttagaactttagttatattgtacttatattcagtaaagaaaatacttaacataagccaacaattgtcagcttgtcctaatttagttagaattgttaatattgcctgtgtatttacccagttcaaagctggttccgttgccagtattttattttctattttataaccagttctcaataggctccaataaggaataatttttctaccacttacagcaactttctttgccaaatccacaatatcttctatcaactcaagatgttgtgatttcttcaaacttatctcagaaccacaagaattgctaaatttctctcacttagatgtaatctttttattgcgtacccaccccatcccagttaagctgagtcacacgaacataattgtcggtcataaattgaggagcaacgacatagtcacccatattagggcaattttctaacaagacataatccactacagtgaaactttctttggcaaaatcatccatggtgcacgagcaggggcttgcagcccatgagcctcagatgcaggctaccactgctgccacctccagttcttcatgtcagccagatggcaggagggagcaagtgggcctattacagttttaagagatgaggtctcactgtgttgcccaagctggccttgaaatcctggactcaagcgatcttcctgctttaacctcttgcatagctgggactgcaagcatgagccacagtgcttggctgaatgataattcatagtagctaaaatgtagcaacctaaatgtccatcagcagtgaatactttagcataatgtgctatttccattcactggattattatttagccttaaaaaggaaggaaattctgatatatactacacattacatgaatcctaaggacttatgctaagtgaaataacccagccacaaaaatataaatactgtgtaattccactgacatgaagtatatagagtaaccaaaatcatggagacaaaatagaatagtggttactgggaagaagggcaatggggacttaaaacggccatagtttcagttttataagatgaacagagttatggagatggatggtggtaatggttgcacaacattgtgaatatatttaataacactgaactgtgctcctaaaaatggttaagatagaacattttatgttttttgtattttactaccattttttacaagttgaaaaaaaaatagactcctggatatagtattcaaatttctgagctatgcaaatatgtaagatcttattcagtcatcagtcttcggttttcttcccacttccttaccacttttcctttcctcggtaatcttcttactgctaataatgatctttggaagccctttgtaaccttgtattttctaaataaacccaagggtgaacacaaataactttgctgtgatttaaaataaaatagcaattatatctaacctaacagaccttatcagaaataaacttttttttttttttttgagacagggtattgctttgtcacccaggctggagtgcagtggggcaatcatgcctccctgcagccttgacttcctgggctcaagcgatcctcccacctcagcttcctgagtagctgggaccacaggtgggcaccaccatgcccagataatttttgtattttttttgtagagatgggattttgccatgttgcccaggctggtcttggaactcctgagctcaagcagtcagcccgcctcggccccaccaaagtgttgggattacaggcgtgagccactctgcccagccagtgactaactttctatccaggttttttaaagtctgggtgtttttttgtttcttggatagctaatcattggcaaaatgcagtgaaaaagctgatccagctcttcttttcagcctgtggtggaatgttacttcttcagtgtcagtttatgtctcagaaagaagtaagccattctgtcttgtaaactttctgtgataggatgtatttggttgagaatatggactctgtagcaaaactgtcctgagctacactaattactagctgtgtaatcttggacaagttacttaaatgtgaagtgcttagaacagtgtctggcatatacagttgacccttgaacaatgcaacggctagaggcaccaacccccagcaagtcagaaatctacatataaattggaattcctcagaaacttaactaccaataacctactgtttactggatgccttatggataatgtaaacagttgattaacatattttatgttatacatattatatactgtattcttacaataaagtaagataaaaattccttaaatcataaaagaacatttgtttactattaagattgaaaatatatttactatcttttcatcttcatgatgagtaggctaaggaggaagaggtgggattgcttttgctgtctcaggagtggcagggatggaagaaaattcatgtataagtgaacccatgtagttcaaaccagtgttgttcaaggatcaactgtgctgagttctcagtaaatgttagctattactttgaccatcacaattttatctaagtgctctggtccatacccagagtatgagcgcacctcattttattgcactttgcagatagtgtatttttttttttttttaacaaattgaaggtttctggcaaaccttcattgagcaagtctgtagccgccatttttccaatagcatatgctcacttcatgtctgtcacattttaaaaccttttcattatgccgggcgcaatggctcatgcctgtaatcccagcactttgggaggccgaggcgggcggatctcgaggtcaggagatcgagaccacggtgaaatcccatctctactaaaaacacaaaaaattagctgggcgcagtggcgggcgcctgtagtcccagctatttgggaggctgagtcaggagaatggcgtgaacccggaaggcggaggttgcagtgagctgagatcccgccactgcactccagcctgggtgacagagtgagactctgtctcaaaaaaaaaaaaaaagcttttcattattatttgtcagtggtgatcagtagtttgttttgttttgttttgttttgttttgttttgtttttgacggagtctcactctgttgcccaggctggaatgcagtggcacaatcttggcttactgcaacctccacctcctggattcaagcaattctcatgcctctgcctcccgagtagctgagattactgacatgcaccaccatgcctggctaatttttgtatttttagtagagatggagtttcaccatgttggccagggtgatcttaaactcctgacctcaagtgattcacccgccttggcctccccaaagtgctgagattacaggcatgagccactgcacccagcagatcagtgatctttgacattactattatacttgttttgaggtgccatgaactgtatccatataggagagcagacttgaaatgttgtatatgttctgactgctttgccacattgctattcccttgttctctttctctcctcaggcctccctatttcctgagacacaacaatattgaaattaggccaactaataacacatggcctcttaagtgttcaagtgaaaggaagagtcccacctctctcactttaaatcaaaagttagaaatgattaagtttagtgattaaggcatgtcaaaagccaagataggccttttacatcaaatagttaaccaagatgtgaatgcaaaggaaaggttcttgaagaaaattaaaagtgctactccagtgaacatggggataagaaagaaaaacagccttatcactgataacggagaaagtctgagtggtttggatagaaaatcaaaccagctataacattcccttaacaaaccctaagccacagtaaagccctgattctctttaattctgtaaaggctgagagaggtgagggagctgcagaagaaaagtttaaagccaggagaggttggtttatgaagtttaagaaaccatctttgtaacaatgaagtgcaaggtaaagcagcagcacatgctgatatagaagctgcagcaggttatccaggagaaccagctaggatcattgatgaaggaggctgcactaaacaacagattttccatgtaaatgaaacagccttctattggaagaagatagcatctaggattttcatagctagataaaaggcagttgcttcaagggacaagttgactctcttgttaggggctaatgcagctggtgattttaattggaaaccaaatttaacattccaaaaaaagcttatttaccattccaaaatcctagggcccttaagaattatgctaaatctactctattaatggaacaacaaagcctagatgatatcacatctgttttacagcatggtttactgaatttattaagcccactgtggagatctgctcaggaaaaaaggttcctttcaaaatgttactgctcactggcagtgtacctcttcacccaagacctctgatgggaatgtacaaagagattaatattgtttgtgtggtttttttttttctttttagacggagtctctctctgttgcccaggctggagtgcagtggcacgatctcagctcactgcaagctccacctcctgggttcacgccattctcctgtctcagcctcccgagtagctgggactacaggcgtccgccaccacgtccggctaatttttttcgtatttttagtagagatggggtttcaccatgttagccaggatgatcgcgatctcctcacctcatgatccgcccgcctcagcctcccaaagtgctgggattataggcgtgagcgaccgtgcccagcctgtttggttttttaagacaaggtctcattctgttgcccaagttggagtgcaatggtacaatcatggctcactgcaggctcagtgtccctgggctcaggtgatccttccacctcagcctttagctgggactacaagcacatgccaacacacccagttaatttttgtgttttggtagagacacagtttgaccctgttacccaggctggtttagaactcctgggctcaagggatttgcctgcctcagcttcccaaagtgctgggattacaggcatgagctaccatgccttgcctgagattaataccgttttcatgccagatagcagtattcattctgtggcccatggatcaaggagtaatctcaactttagtcttattatttaagaaatatatttcatggcctggcacagtggctcacacctgtaatcccagcactttgggaggtcgaggcgggtggatcacgaggtcaggagattgagaccatctggctaacacggtgaaacccagtctctactgaaaatagaaaaaaaattagccgggcgtggtggcgggcgcttgtagtcccagctactggggaggctgaggcaggagaatggcgtgaacccgggaggcggagcttgcagtgagccgagattgcaccactgcactacagcctgggcgactgagcaagactctgtctcaaaaaaaaaaatatatatatatatatgtgtgtgtgtgtgtgtatatatatatatttcataaggctatagctgacatagtgattctgctggtaaatctggaccaaataaattgaaaaacatctggaaaggattcaccactgtagatgccattaagaacatatttatggccaggcatagtggctcatgtctgtaatcccaatgttttgataggcccaggtggtggatcccttgaggccaggagtttgagaccagcctgggaaacatagtgagaccatctctacaaaaaattagccatggcccggtgcggtggctcacgcctgtaatcctagcagtttgggaggccaaggtgggcagatcacaagtcaggggtacaagaccagcctgaccagtatggtgaaacctggtctctactaaacatacaaaaattagccgagtgtggtggcatgggcctgtagtcccagctacttgggaggctgaagcaggagaatcacttgaacctgggagacggaggttgcagtgagccaagatcacaccaccccaccacactccagcctaggcaacagagctagactccatctcaaaaaaaaaaaaaaaaaaaaaaaaaaaaaaaaattagccatgcttggtggtgtacacctgtagtcccaactatttgggtggctgaggtgggaggatcacttgagcccaggaattcgaggttgcaatgagctctgatcttgccactctattccagcctgggcatgagagtgagaccctgtctctaaaaaaaataattaaaatgaaaaagagcatttgtggtacatgggaggaggtcaaaatatcaacattaacaggagtttggaaaaagttggttcccacccttattgatgactttgaggggttcaagacttcagtggaggaagtaactgcaaatgtggtgaaaatagtgagagagctagaattagaaatggagtcgaagatgcgactgaattgctgcaatctataatgaaacttgagcagatggaagagttgcttcttatggatgagcaaataaagaagtttgtttttttaagatggaatctactcctggtggagatgctgtaaacattgttaaaataacaaggtatttaggatattacataaagtgagtttataaagcagcagtagggtttgagaggattgactccaattttgaaagacgttctaccatgggtaaaatgatatcaaacagcattgcatgctacagagaagtctctttgtgaaaggaagtatcaatccatgttgcaaactttattgttgtcttattttaagaaatgtcagctgggcatggtggctcacgtctgtaatcctagcactttgggaggctgaggcgggtggatcacaaggtcaggagattgagaccatcctggctaacatggtgaaaccccgtctctactaaaaatacaaaaaaaaaactagccaggcatggtggcaggcacctgtagtcccagctactcaggaggctgaggcaggagaatggcgtgaacccaggaggcggagcttgcagtgagccgagatcgcgccactacgctccagcctgggcgacagagcgagacttcgtctcaaaaaaaaaaaagaaaagaaattgtcgacccgagaaacagcgagatcttgtatcggcaaaaattaaaggattagccagccattgtggcacgtgcctgtagtcccagctactccggaggctaaggtggaaggattaccagagtccaggagtttgtggctgtggtgagctgtgattgcaccagtgcactccagcctgggcaacagagcaagaccctgtccgtccgccgccaaaaaaaaaaaaaaagaaaaacggtttacacttcagcgaaagaaaaagaagttgctatatccaccccaaccttcagcaaccaccaccactctgatcagtcagcagccctcaacaatgaggcaagttcctccacaggccaagattatgactcactgaaggctcagatgattgttagcatttttagcaataaagtatttttaaataaaagtatgtaccttgttttttagatacagtgctgttgtacacttaatagcctacagtataatgtaaatatatgcactgtgaaaccaaaaagttttgtatgacttgcttactggaatagttgctttattgcaatgatctggaactgaacccacaatatctccaagatatggttatactaagtagtctgaaaatacaaaatagtctagtaataaatagtctataataaataatatattaatataattatatttattaattattaataattattaatatatattaatatatttttatataatatataatataaaatatataataaataagtagtctagtaataaaagaataccagcctgggcaacatagtgaaaccttgtctttaccaaaaatacaaaaaattaactgggtatggtggcatgcactgtagtcccagctactcaggaggctgaggtgggaggatcacttgagcctgggaggcagaggttgcattgagtctagattgtgccactgcactccagcctgggtgacagagtgaggccccatctcaaaaggaaaaaagaataaaatgctttcctctacattcttttttttttttttcttttttctttttaagacagagtcttgctgtgtcgcccaggtccggagtgcagtggtgcgatcttggctcactgcaacctctgcctcttgaattcaagcaaatctcttgcctcagcctcctaagtagctgggactatggccgcgtaccaccacgcccagctaatttttgtatttttagtagagatggggtttcaccatgttggccaggctggtctcaaactcctgacctcaagtgatctgcccgcctcggcctcccaaagtgctgagattacaggcgtgagtcaccacacctggcctcccctacattcttgaaggaaagcatttacttgttatttcttaaattatggttaaatacaggtaatataaagtttaccatcataaccattacgtttttttctttttgcatagaacatttcattgtcatgtacccattttaaagcataccagtgtcatcaagttttttcacagtgtgcaaccatcaccactatctagttctagaatttcatcaccccaaacaaactccatacctttgagcagtcattctccgttttctcctccacttaactcctggcaacaacaaatctattctgtcttggtgaatttgtctaatctgtatatttcatataaatggaactatataatatgtagccttttgtgtaggcttctttgatacagtgtgttttcttttttcttttttttttttttgagacagagtctcactgtgttgcccaggctggagtgcagtggtgtgatctctgcttactgcaagctccgcctcctgggttcatgccattctcctgcctcagtctcccgagtacctgggactacaggtgcctgccaccacacctggctaattttttgtatttttagtagagatggggtttcaccgtgatagccaggatggtcttgatctcctgacctcgtgatccacccacctcgacctcccaaagtgctgggattacaggcgtgagccaccaaacccagctgatacagtgtgttttcttggtatatccatgttgtagcatgtattagtacttcattcctttttatggtcgactatttccttgtatggatcaaccacattttgtttattcatatcatggtaaacatttgtgttatttccatcttttagctgttttaaatagtgctgcagtgaatatttatgtacaagcttttgtttgaacaccttgttcaattcttttagatatatgcctagaagtggaattgctgagtcacatggtcattctgtgtttagtttattgaggaactgcaaatccaatttccatagcggctgcaccatcttatattcccaccagtagatgtatgagggttccaatttctctgcatttttgctagcactcattattttccattttttaaattatagcgatcctagtgggtgtgaagtggtatttcttggcagttttgatttgacattcactttttcttttaaaatatgaagtgtaggttctgtccattgccttacattattagttatgttttactagtaatatatatattctgccttgtctatttcacagtggccatattcttctcttgggtattatctcctatctttaactaagctataaattccttagagacagggtatcaggttctaatgctacctgatacatccagccagggcaggtgtttgttcgtcttacaaggaagacaatagatataaattttttttttctacagcctcgacctcctgggctcaggtgattctcacacctcaccctcccgagtagccgggattacgggcacgcaccaccatgcccagctaattttttgtatttgtatttgtatttttttgttttgtgtgtgtgtatgtttaattttttttgtatttttagtagagacggtgttttgctatgttacccaggctggtctcaaactcctggacagaagctgtctgcccgtcttgacctcccagagtgatgggattatagatgtgcaccaccgtgcccggccagacatacaatattgtcagctttttattttctctcccttccttgaccaccattttctgaatcttttagcttatattttacctctgcatggaattgtccctgttgaatcatctcttgttagaattctacttattcttctccctcttttcctaaagccttttctgatcagtctaataaaaatatgatacttcccttttgtttttactgccgcttgagcacctactttgtattaaacattttactttatcgactttaaatcttcacagtggcccacaaggtgatactcattctccacaagatattaatgttcagagaaattatataacttgtctaagtagtataggagctgagatttaaacttaggtctcaggcaggtgcagtggctcacatgtgtaatcccagcattttggaaggccaaggcgggcagatcagctgaggtcaggagtttgagaccagcctggccaacatggcaaaacgctgactttaccaaaaatacaaaaattaggcaggcgtggtggcacacggccatattcccagctacttgggaggctgaggcacaagaatctcttgaacctgggaggtggaggttgcagtgagccaagatttcgcaccactgcactccagcctgggtgacacagcgagactgtctcaaaataaaattaaagaaataaataggctgggcatggtggctcacgcctgtaatcctagcactttaggaggccaagacaggcggattgcctgagctcaggagttggaggccatcctgggcaacatggtgaaaccccgtctctactaaaatacaaaaaattaggtggggtagtggcgtgtgcctgtagtcccagctactgtggaggttgaggcaggagaactgcttgaacccaggaggtgggaggttgcagtgagccgagagcgtgccactgcactccagcctgagcgacagagcgagactccgtctctaaaaaataaataaacaaacttaggtctctttgactccaaagctattgttttctctccactactattttatgctgactcttgtggccttatgcgttttgttgtagttgttatagttaacaagaatctgatatagattttcgtgtccatcctggtgtctttatcattctataaatatttgtggaataaatgaaaaggggactttgttcttcatgaactaggataattatcttcatgggctaggatattagcaacaggtttgcgaaatagccctgtttaacaaaagaatataaattcaaaatcagtctgttacccactaaattatggatacttcattcaaattatgagatagattaggtcaacctgcatcaaatcagtatagatcagtaagtaagagcttgactctagagtgagcctgccccggttcttttcctgctttgttctgtaagttacctaacatctgctttctcatgtatgaagtggagattagtatttagcatttagaattgttaggattaaatgagacattagataaaagagtcaacaactgactgtatagtaaacatgccttagggaataattattattaacattatccattgtctttcccattctttgtgatttgattatgattgttgagtgagaactttttccttgtgtattattgaaaataagaaaggacagtattttttcttctactttttaaaaaatattcttactatatttaaggatattagtggctcgatagagatgatcgatgcatcttttatggcagggagtcgtcgcatggtggatgtcatggacgtgaacacacagaaaggcattgaaatgaccatggctcagtggacacgctactatgagaccccagaggaggagcgagagaaactctataatgtcatcagcctcgagtttagccacaccaggctggagaatatggtgcagaggccctccacggttagtgtaatcattttcttcatattgtcattgtcaccaaaagggttgttttcggctggacgttggtaactgatgcttgttatcccagcactttgggaggccaagggaggcagatcgcttgagctgaggagtttgagagcagccggggcaacatggtgaaaccacatctctacaaaaagtacaaaaaaaaaaattagctgggtgtgatggcacatgtctgtagttccagctactcaagaggctgaggtgggaggatcacctgagcccaggaggttgaggctgcagtgaccggtgattgcaccactgcattccagcctgggtgacagaacaagaccctgtctcaaaaatttaaaataaaatgcgttgtttttatactgggaaattttataactttttgcacatatcaagattaagctgaaggtaaacaagactatttgacaagaataatttgtatttttataaagatatattgatattgtattttgataagaataactgcattttccgaaatcataataaattttaaaattttaaaatttattattattaaaaaaattttttttttttaaagacagggtctcacaattttgtccaggctgaccttgaactgctgggctcaagcagttctcccaccttggcctcccaaagtgctgggattacaggcgtgagccaccgtgcctgggcgtgaaatcacttaattttatatagggcaggattattctgatttgtatcacagtaacttaatgtaggaacattgacctttggatgtaacggagaggaatattaaaattcaaccttggggccaggcgcagtggctcatgcttggaatcccagcactttgggatccgaggtaggcggatcacctgaggtcaggagtttgagaccagcttggccaacatggcaaaactcccatctctactaaaaatacaaaaattagccaagcatggttgcatgcgcctgtaattccagctactcgggaggctgaggcatgagaatcgcttgaacctgggaggcagaggttgcagtgagctgagatcatgccactgcactccagcctgtgtgacagtgagaccctgtctcaaaaaaaaaaaaaaaaaaattcactcttgaccaggcatggtggctcacatttgtaatcccaacactttgagaggctaagacaggagaattgcttgaggccagtagttcaagatcagcctggggaatgtcacgagacccccaaaaataaaaataaacatttttattatttattattttttttttgaggccgagtctcacattgttgcccgggatatagagtgcggtggcacgatctcggttcactgcaacctctgcctccccggttcaagcaattctcctgcctcagcctcctgagtagctgagactacaggccaccatgcactgctaatttttgtattttttttgttagagacggggtttcatcatgttggccaggctggtcttgaactcctgacctcaagtgatcgacctgcctcggtctcccaaagtgctgggattacaggcatgagccaccacaccgggccgaaaggaactatttttgtattagtaatcatgtttatttgatcatatggaagtataggaagacaggtggttagaatttagccttcttattagcctaatgtgatttgctaaataggaatttagtgagagggatgggatgtaagaattccagtaacattatttatttataattttattttcttaatatttctagaattttattttattattattattattattattatttttgagacaggttctcgctctgttgcccaggctttagtgcagtggcacgatcttggctcactgcagcctccgcctcccaggttcaagcaattctcccacctcagcctctcaaatagctgggattacagggacacaccaccacacccggctaatttttgtatttttagtagagatggggtttcaccatgttggccaggcttgtctcgaacccctgacctcaggtgatccacctgtctcagcctcccaaagtgctggaattacaggtgtgagccactgtacccggccaatttccagaattttaatttaaaaataacaggattggccacacacgttggctcatgcctgtaattccagcactttgggaggctgaggtgggagtatcccttgagcctaggagttcaagaccagcctggttaacatagcaagacctcatctctacaaaatttggaaacttagccaggcatggtggcatgcacctgtagtcctggttactcaagagaccgaggtgggaggattgcttgagcctgggaggttgaggctgcagtgagctgtgatcactgtagcctagccaacattgcaagaatctgtctcaaaaaaataataaaatgataaaaaatgtaaatagaagccgagcatggtggctcatgcctgtaatcctagcacttggggaggccgaaggcagacagattgcttgagctcaggagtttgataccagcctgggcaacatggtgaaaccctgtctctatagaaaaattagccaggcatgatggcgtcccccatgtagtcccagctactcagggggttgaggcaggaggattgcttgagcctagtaatttgagaccagtctgggcaacataataagaccttgtttctacttttgaaaaaaaaaacaaaaaacaaaaactaagcagcaacaagaaaaataacatgattgtagctataaatgtaaaacttgacctggtcaatactttaccattattaaggttgtgaaatgtctcactattccacatgaagccttttttgtggcatcctgaatttattcactctgtccctagttttaatgataaaaatgtgacatcattttataaaaattagaaaaatatattaacattaaagggcggagaagaacctatgagagggctcagaaatagaaaattattaagagagcagaggccacaatactaatatcttacggggacctaaaacatgaaagattgaatgagctattaccaagctcacattctaaaagcaggtaaggtttttgtgaccttgctatgtaagtaataacgtttattttgttgatagaataagatagaagacttcatgtggaatagtcacacatttcaaaatcttaataatggaaaagtatcgaccaggtcaagttttacatttatagctagaggcctggcacagttgctcacacctctaatcccagcacttcaggaggccaaggtgggcgtatcacttgagcccaagagttcgagaccactcgggaggctgaggtacaagaatcacttgaacccgggaggcagaagttgcagtgagctgagatggtgccactacactccagcctgggtgacagaatgagaccctatttcaaaacaaacaaacaaacaaaaacatagctacaatcatgttatttttgttgttgctgtttctattggtagaattcttattccccccatagtatatcccttcatttatctaggttttttccagtatatttcactagtgctttttttaaaaaccaactttattgaggtaaaattgatgttcagtaaagtggacccccattttaagtgtgcatttcagtgagttttgacaaacatatttattcatgtaagtaaccaccatagtcaaaatatagaaaataagccaggtgcggtagctcacgcctacaatcccagcactctgggaggccaaggcaggcagatcacttgaggtcaggagttcaaaaccagcctggccaacatggtgaaaccccgcctctactaaaaatacaaaaattagctgggtgtggtggtgcacacccgtgatcccagctacctgggaagttgaggtgggagaatcgcttgaaaccaggaggcagaggttgcagtgagccatgatcacaccactgcactccagcctgggtgacacagtgagaccctgtctcaaaaaaaaaaaaaaaaaaaaaaaaaaagaatatatatataatagcctattagtagttcttttttaattttttaatattcaaaaacttaatcttcatttctaaaaacttaatcttcatgtctaaaaactttgatctgtcacttctcactttatatcctcaagttctaacctatttgcatttcttaatcctagagttacataatctgtttgttccctgtgatcttcacaaccttcagggtttgcctattcatttatcagatgcctaccacatgctaagcactgtctaggtactagagatacagtggaaaatgatatcattcttgttagagactcaaagaaagacaagaaaatatgcatttatataaactatagtatgagcagtgcttcaaaagtgaataaacagccaggcaaagtagcacatgcctttagtcccagctacctgggaggctgtggtgggagaattgcttgagcccaggagtttgaggcagcctaggcaatgtggcaagacccagtcttttaaaattaaaaaaattgaataaagcaggatattgtggaagcattttggaaggatgacctaatttagaaactataggagaattaggggaagctctttggaggaagtggtgcctaatgttgacataaaagaaataatgaagcaaggagagggagaccagaattacgggcagaaggaatagcatttgtaaaagtaggttccgggaggtaagaagggcaacttttacatgcctgttataggagctagcataaagtagagttctatggtgagaagagattatttagtgctgccattccagcaataactgagaggtagattttaaaatggcacaaataatacacatttgtttggtgatggggaaataagttcatggaaggctatgagttgtttatgaatagactaggttcatgatattggacttcttaccagtttggccctagttttgttgcagaacagattataactgggatcagagtatttagcaaaggatctatcccaaggctaaagattaacctaagaagaaaagcacgaacatgttaccacaaattctctctgtagtctgaagatacctaataataccaaagaaaggcaggcaaaaatgactgactttcttgctgcaattaagaaattctgctttctgtgaatgaatgcgtggtaaaaaaaaaaaaaatactcatatgttctgaaccgttcctctccctattcagacatgggagcttacagcgtattaagcaagtactttattcattattctgttaaaggcattcccatggacaacacacggggatgggagatggtggctactacattaagaaacagtaaattttatttgaaggaaagaaaggcatccagggcttattcaatgttctgggaccggcggatgcttggttaaaattgttggctccctgagcagaaattctttgaaatggaacagcaggttaaccttaaccgttgctcctcatcttgtttgtttcttccatgtcagtggtgatgctttctaaacactctcccacagttaacatctgggtatcctctagacaactgcttcatatcatgcacaactttatgcatttgtctccattcacattataagggaagtaagtgatcaaatacgtagatgttgttacaaagcttaccagatacatgttttttataaccataagttagatatttaccacatcagcactgtgctgaattcatggtggtttggctctcgagttttacctacctggagttcattggttgagtgtagacacttgaaggcacaggaaatgttataatttagtgtaaaatgttgcgtattgctttcacttctcttttttttcagccagtattatttaaaagattcctggccgggcatggtagctcatgctgtaatcccagcactttgtggggctgaggctggtggattgcctgagatcagaagttcgagaccagcctggccaagatggtgaaaccctgtctctactaaaaaatacaaaaattagttaggtgcggtggcgggtgcctgtaatcccagctactcaagaggctgaggcaggagaattgcttgaacctgggaggcggaggttgcagtgagctgagatcgcaccacaacattatagcctgggtgacagagcagaccgtctcaaaaaaaaaaaaaaaaaagatttctgtattctcacattatttcagattttaaaagtgtttacatttaatccttacaacgtatctttgaagtagttatcttagtttttttgtgtttttgggttttttattgagacagtcttgccctgttgcccaagctggagtgcagtggtgatcgtagcttactgcagcctcaacctcctgggtttaagcaaacctcccatcttagcctcacaagtagctaggactataggcacatgccacaacgcctggctgttttttttattttattttatttattttttgagacggcgtttcgctcttgtttcccaggctggagtgcagtggcaccatctcggctcaccagaacctccacctcctgggttcaagcgattctcctgcctcagcctcccaagtagctgggattacaggcatgcgccaccatgcgcagctaatttttttttttttttgagacggagtcttgctctgttacccaggctggagtgcagtggcgcaatctcggctcactgcaagctccgcctcccgggttcatgccattctcctgcctcagcctcccgagtagctgggactacgggcgcccgccaccacgcctggctaattttttgtatttttagtagagatggggtttcaccatgttagccaagatggtctcgatctcctgacctcgtgatccacctgcctcggcctcccaaagtgctgggattacaggcgtgagccactgcactgggcctaattttgtatttttagtagagacgggatttctccatgttggtcaggctggtcttgaacttccgacctcaggtgatccgcctgccttggcctcccaaagtgttggggattacaggtgtgagccactgatcccaactatttttttattttgaagagatgggttctcactgtgttgcccaggctggtcttaaactcctgggttcaagtgatcttcccaccttggccttccaaagctctgggattgcaggtgtgagccactgtgcctggtctatcttagttttatagatgagtttgagggccttatatagtcttgaaaagacatgatagacctggagcttcttattcctaagctggtagtttctatagcacattgtcaatgcaaggctataaatctatactggatttttttcttttttttggcctaacttttggcatcttaactgttctaacaatggtatatattttgctgagtttatagataccttccagacaacaccttttattggattaaaaaataaaacaaattatataagtattgacatagaagagagttcatagttatacactattgcataattaatgattccattttgactagtgctgtctttactattatcatttgatggaatgattaatctttattctcatataacaattatttctaggatggttgcctagtaatcctaagattcgccaacagatttttttaatttgcttataattaaattatagttttttgttatgtattttaagaaattctgcttttcttgactttaaaattatctttgaccccaacctttcccttggagcccaagtgtttcctccttctatttaaaggtggatttcattgactgggtagacaacatgtggccaaggcacttgaaggaaagccagactgaatcaacaaatgccatcttggagatgcagtaccctaaagtgcagaagtaagtgatgcgccctgcatcttcctccgtgtgctgtgggagaccaaagcaatagcaaggattggcttctcccttacgagctttgctctgtgtcttgaatgattaaaaagatgaattatttaaagatgagactttacagttccacaaggaagagtgtatgtgagcataccatagcacacaaccacacagttaaaggaaaaaaaacttacattttagtcaatacggtagaaaaaaaaaaaacctttttctgataatgtgatgacttgaaaatgcattgctttttctccttctggaacttaagattaagtggaagataaagggagtatataagaggagagtatggcattttggtggggcagatgtacttttttccatcagtacactaatgctgctgctttttttgggtcaggtactgtctaatgagtgttcgaggctgctatactgacttccatgtggactttggtggtacctctgtttggtatcacatccatcaagggggaaaggtatggtcatagttgtgataggggttggaatctgaagttggttgtatgactttgcttcagttcatgtatacttaatataccctggaaatgaatctgttagggaattgtccccattcgtatctggaaagaattatagattaagttcaccttcttggctagtgttcagtagaaattagtattcatctagttcactgtcattacaccattggcacagcacttagtaaatctcaatagtcctgtttctagattcctgaatcagagttctccaaatgaagccaaagaagtgattttagaaggacaagataatttctgtacttggaagtataataaatagtggaagggaacacgaattttggatagattcactgtgaaatcagcaaattaagatctaaaccaactttccctctatgtagccattggtctgaaatatggccaaaggaagcctttaagtcctttttgaggatgtaaacaggttttgaaggattatctttattcattcagttatattccagcttgtgaaaatgcttctgaatgctatatgagaatggaaatctagaattaatacccgaggtttatagtattatactcttgttactcttttttctctaacttgcagtgaatgcatttgtaagagaaaagtaggaactagaatgagaatagataatgccttgtttaaaacatgaggtcttggccaggcatggtggctcacgcctgtaatcccagcactttgggaggccaaggcgggcggatcagctgaggtcaggagttcaagaccagcctgaccaacatggagaaagtgcatctctactaaaaatacaaaattagctgggtgtggtggtacatgcctataatcccagctactcgggaggctgaggcaggagaatcgcttgaacccacaaggtggaggttgcggtgagctgagatcgcgccattgcactctagcctgggcaacaagagcaaaactctgtctcaaaaaagaaacaaacaacaacaacaaaaaaacatgaggtcttgtccgggcacagtggctcacgcctgtaatccaacactttgggaggccaaggtgggtggatcataaggtcaggagatcgagaacatcttggccaacatggtgaaaccccgtctctactaaaaatacaaaaattagctgggtgtggtggcgcacgcctgtagtcccagcaactctggaggctgaggcaggagaatcgcttgaacccaggaggtggaggttacggtgagccaagattgtgccactgcactccagcctggactacaagagtgaaactctgtcaaaaaaaaaaaaaaaaaaaaaaagtcttaatcagaacaactatgtctccaaatccaaaagtcattttgtttgcttcagatccctttaagccctgttgatcttagttactaccttggacaaaacaacctgagccagtctcttgaagatactgtgcctaattaactgtactacttaggactctggaagccagacagagtgtttaagggactgcctaggtaatgagctgaatggtccctcttctctccgagtcctggatggtgtatagtcaaacccaagggaagccttaatgctgttggatcaagtgaaggataagaaagatctactgccttggaccttctagggtttaccacatagtcaagttctataggctgggaaaattgcttgcctttcttctacctggtggtcttaattttgtacctgtttatcagttgagggagacgactgggtcatgtcaatggctgttaacagactaaagttttttaactcacaggtcttctggctcatcccccctacagcccacaacctggagctgtacgagaattggctgctgtcagggaaacagggagacatctttctgggtgaccgggtatcagattgtcagcgcattgagctcaagcagggctataccttcgtcattccctcaggtaagcaaaatgggaagagtgggttatttagccatttttttccttaatgaaaaagaaattgatggattaccaccaagaatagttatgatgctgggcgtctgcagaaaacaacagtgtttcttcctgtcattatggaatagatgctgaggttttgtttgttttgttttcagtttgaaaaggcagtggttttccaataaagtatatgagaattgccagcagaggcttttcaggtatacacgtttgggctctgcattagccctagtaatttagaatctctatagataggacctgttctgcaggtgatacacaatctatgttgaagaactgcctactattctagggaatggctgtgaaggctggagtgctcagtcagggatgtttttgatcaagtcattaaatcaaagtaagtgcttataaagatcacagattttggagtcacagacctctattaggattctgactatgcatttacctgctagatactacgcttagagcaaatatttaaatctgtgtctcattttgttataaggaatataaatgagaacacatgtaaaccaagcttatccaacctgcaggccacaggcctcatgcagcccaggatggctttgaatgtggcctaacacaaattcataagccttcttaaaacattatgagatttttttttttgcaattatttaagcttgtcagctgtcattagtattagtatattttattttatttatttatttatttattttgagatggagtcttgctctgtagcctcaggctggagtgcagtagcgtgatcttggctcactgcaacctccacctcccaggtcccagttcaagcaattctcctgtctcagcctcccgagtagctgggattacaggtgtgcaccaccatgcccagctaatttttgtatttttactagagacggggtttcaccatgttggccaggctggtcttgaactcctgacctcgtgatccacccgcctcagcctcccagagtgctgggattataggcgtgagcccccgcgccaggtcatgttagcgtattttatgtgttgcccaagcaattcttcttccagtgtggcccagggaagccaaaagattggacacccctgaattgtaaactatcttgtacagagcctggtttatagttggtgctccagtaaacgtttattatgtgctaagcatttgatgtgcattttctcatttaatgctcatgagcaaccataagaggtattatttatcctggttttatagaggaaattgaggctttgagagattaagtaacttgacaaaccactaagaagcagaatcagagtgaagagtgtgatctaggggtcttgtactagttctctgagagagacttactgtaatgtgtgttttcagccactgccctctgttccccttctcctaggctggattcatgctgtgtatactcctacagacacattagtgtttgggggcaattttttgcatagcttcaacatccctatgcagttaaaaatatacaacattgaagatcggacacgggtaagtaatcttatgtaacagttgcatgtgaagaggtttactccagttatgatagatgttacaagagattcactgatggtttatcaaaacttccatttttctttcagttaaaatgcagtgttgacattttgggaacacacaaaattttaaatttaatttttttttttttaaggcagaatcttgttctgttttccaggctagagtgcagtggcgtgatcatggatgattgcagcctcaacctcccaggctcaagcatcttcctgcctcagcctcccaagtagctgggaccgtgggtgcacaccacatctgactaatttttaatttttttcgtagagacttggtctcactgcgttgcccaggctggtctagaactcctggttcaagcagtcctcccacctcagcctcccaaagtgctgggattacaggtgtgagccactgcgactggccaaataaaaattttaacacgatttacatactccgttttagggactccaattctgtgaggtttttggtatcttggatttctttttctttcctttttttaaaattttattttattttattttattttttagccaacaccatagtgaatgggaaaaagtaacatttttttcttttaatatttgggacagagtctcactctgttgcccaggctggtgtgcagtgtcacagtcatggctcactgcagcctcaacctccctgggctcagttgatcctcccacctcagcctcccaggtagctgggactacaggcacacgccaccacatgcagctaatttttttgtattttttggagatgggtttttgctgtgttgcccaggcttgtcttgaactcctgggctcaagtgatctgcccgctttggcctcctaaagtgctgggattacaagtgtgagctactgcatcccacagtatcttggatttttataaggccagacatttacctctggtaatctcttgagccatgtgtttcatttttatgctcacagaataatttggtgtaatggggcttatcaacccaaatttcagaactttaaattcatgtatctttttctacactgatgactatactcaaagcatcttactttaattatataaatgtatatactgtctttctcaactggggtttcaagagagaattaagcccaaaataaaataatttgtgtatcttattttctcatttttctctaggatgatacacagctaatacccttctagatgcatagaaaaaagttaatttattatatacaatggataccttaaggcaagagttgacaaacttttcctgcaaaggaccagatagtaaatattttaggcttcgtgggtcataaagtgtctattgtaactgtttaaccctaccttgtagcatgaaatacttaaacaaatgagtgtggctcaaataatataaaattttattcatagacactgaaagttgaatttcagataactttaacatgtcacagaatactcttaaatttttttcaaccattaaaaaatgtaaaaaacgatccttttatatagttcatgatcatgattaggtgttcatgcacgtatgtgaaagatgccacccttgaaccttgttactattaatacgtcagcacattacctgtctgacccgaaaaaaaaaaaaaaaggtaaaaaacactcctagttcacaggaatcataaaaagaggcagcaggccaaatccactaagtgttgtttgctggctagcctccaccttagagaatgagagcttattttttagcagaattctaattggtaagggctgaatcatatatgaaagtatagatgatactgggattaaacagcaattagaatatttgggggttgtgatgtttgtaagttactctcaagtagcttagcagaatactaagctagtatggagatgagcagatgtggagaaatgttaacagttggagaattgcagagaagagtgtagaactattaatgctactgctcttgaaactttttggtagaattaaaagtattaaaaattttaaaataacaattaatgaagaattcacaacttttatatgaatggtcttttatatattataggaatggtcactgacctatgtactgcaataatagtcaaccattatggtgcctattttgcaacatttattttggtgtaggagttacgtatcactatacacatcattgatattattgttggagttacaggaattgccctactagtagaattaagagaggaagccagtgcttcttcaacacattttataaaagtacatttctttttatttgttaagagtaacaaaagtacagttcaggcacaggggctcatacctgtaattccaaccctttgagagcccaaagtgggaggattatgtgaagcaaggagtttgagactctcctgggcaacaaagccgggtgtggtggtgcatgcctgtaatcctagctactggggaggctgaggtgagaggattgcttgaacctaggagttccaggttgcagtgagctatgttggtgccactgtactccagcctgggtggaagagtgagacacagtctgttaatttaaaaaaaaaaaagatgtctattctaaaataggtaaatattctaaaatagggaaaatgtttcaaaagaaaaaaaatgtataattccatagtaaaatactcctgtttaactctgtcattcttttttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccgttctcaatgagctgttgggcacacctcccagacggggtggtggccgggcagaggggctcctcacttcccagtaggggcggccgggcagaggcgcccctcaaaactctgtcattcttagaggtaattatgtacccattctaagattcagtctgaaaattggtttttagaatgtgttccctttttatggttaaagatgactcttacacctgggtcttatacactggttcagtttcagggaagaaaaggaaaatacatattcagtaacataaagtgagtaccttatcccctgcatgaagagttttctacgtaaagagaagaaaaataagggggaaaaaaaaaaaaggccaggcacagtggctcacacctgtaatcccaacactttgggaggctaggcaggcagattacctgaggtcaggaagttgagaccagcgtgagcaacatgaagaaaccctgtctctactaaaaatacaaaattagccaggcgtggtggcacatgcctgtaatcccagctactcaggaggctgaggcaggaaaatcgcttgaacctgggaggcggaggttgcagtgagccaagatcgtgccattgcactccagcctgggcgacaagaatgaaactccatctcaaaaaaaaaaaaaaaaaattatttccaaaaaatgctaacccagtcttagaaattgatatgcggcataagtaaaaagcaatggggtcaggttgggtatgtggtatctcttggctataattaatacagtcttataagttacgagtaaaaactcaaaattttaatgcctgtatttcatattttcttccttttttctttcttatttatttatttatttatttatttatttttgacacagggtctcactctgtcacccaggctggagtgcagtagcatgatctcagctcattgcagcctcaacctcgtaggctcaagtgatccttctgcctcagcctcctgagtagctgggaccacagacgcacaccaccacacctggctagtttttttatttttatttttttgtagaaacgaggttttactatgctgcccaggctcgtctcaaactcctgggctcaagcagtcctccagcctcaggcccccaaagccttgggaccacgggcatgagccactatgcccagactcttcttttttttaaactgtcattattactcagctttcaactgatttccagagggctttagaatttggagttgtcctgaactcctaataaaaacccttccagaaagtgttgctatacttaaaaggctaatggagaggcgtagtgtattatatttaattttgagggaccaaatacctattggttgttgtctctctcctctgtctcccttagtcagaaataaattaattttacttccgtgtaagagagtcattcttttagttgttaaaagttttagccacataagaaaccagaatcagggtctggctactatgcattagaaaactgattggggctaactatgaaaagtacatctcctctcctgccttgccatggggagagtgatctccttattccccagtgatgccctgtggcctggtgaaggtttttgaaaagggactcctatccagttctccgtgattcaggaacactacccgatatagagtttgtaaacgggtaggtgaagtcatccctacaatatgggaggagatgggaacattctcaggagctgcatattcaaaacagtatcatttggcttatccttttgaaatatggcctctctaaaagaaagctgtatggccagatatggtggttcatgcctataatcccaagtactttttgggagtttgaagcgaaggatcacttaatcccaggagtttaagaccagcctggacaacatagtgagaccctgtccgtaccaaaaattaacccctttcttttttttttttttttttttttgagacagagtctcgctctgtcccccaggctggagtgcagtggtgcgatctcagctcactctgcaagctccgcctcctgggttcacaccattctcctgcctcagcctcccgagtagctggggctacaggcacccgccaccaagcccggccaatttttatatttttagtagagatggggtttcactgtgttagccaggatggccttgatctcctgacctcatgatccacccacctcagcctcccaaagtgctgggattgcaggcttgagctatcttgtccggccaaaattaatccctttctcattttccccaatgatactcaccaggggcacttggcagctgcagcatttttttttttttttttttttttttttttggagacagagtttcgctgctgttgtccaagctggagtgcagtggtgtgatctcagctcactgcaacctccacctcccaggttcaaacaattctcctgcccaggcatcccgagtagctgggattacaggtatgcaccaccacgctaatttttgtatttctagtagagacggggtttcagcaggctggtctcgaactcttgacctcaggtgatccacttgccttggcctcccaaagcgctgggattacaggtgtgagccatcacgcccggcggctgcagcatttaccccaagataactttgccacgaactatctcgcttttattattttcacatcactctagtatactgactttgaaaacaaaagatatcattctatttatagcattctgtttttagtagtggtatttctacttacaaaatatagttattcttgattgctgaaaatgtcaaatcctagaaaacatagcattcctatgcgtgatgttaacatcattcttgggcaggcgtggtggcttatgcctgtaatgccagcactttgggaggctgaggcgggcgaatcactggagttcaggagttcgagaccaacctggccaacatggtgaaaccccgtctctactaaaaatacaacaattggccagtcacgctggctcacgcctgtaatcccagcactttgggaggccgaggtgggtggatcacctgacgttgggagttcgaaaccagtctgaccaacatggagaaggcgtgtttctactaaaaatacaaaattagccaggtgtggtggcgcatgcctgtaatcccagctactcgggaggctgaggcaggaaaatcgcttgaactcagaggcacaggttgcggtgagccgagatcacaccactggactctagcctgggcaataagcacaaaactctgtctctaaataaataaatagctgggcacggtggctcatgcctgtaatcccagcactttgggaggctgaggcaggtggatcacctgaggtcaggagttcgagaccagcctggccaagatggtgaaaccccgtctctactaaaaacataaaaattagctggtcatggtggtgcacacctgtaatcccagctacttgggaggctgaggcaggagaatcgcttgaacccaggaggtggaggttgcagtgagccaagattgcaccattgcagtccagcctgggcaacaagaacaaaactgtgtcaaaaaagagtaaaaataaataaataaataaatttaaaataacaattagccaggtgtaggggcacacacctataatcccagctgctcaggaggctgaggcaggagaattgcttgaacccaggaggtggaggttgcagtgagccgagatcccaccactgcacactagccttggtgacagagcgagattccatctcaaaaaaaaaataataatatatcattcatgaacagttgttggccagagattcatttgatggatctgatttttctgaaatagacaatcctgatgattcagaccatcctgctgttagttttgtttagaaataactccaaagacagtttttatattttatgttcaccttgaaaatcaatcagatttccagccaggcgcagtggctcacgcctgtaatcccagaactttgggaggccaaggcgggcagatcacgaggtcaggagatcgagaccatcctggctaacatggtgaaaccccgtctctactaaaaatacaaaaaattagccgggcgtggtggcgggcgcttgtagtaccagctactcaggaggctgaggcaggagaatggtgtgaacccgggaggtggagcttgcagtgagccgagatcgcgccactgcactccagcctgggcaacagagcaagactccgtctcaaaaaacaaacgaaaatcaatcagatttccttcagcatcaaagagcatgtttatgtaaaattaaatgagcactggccgcgagctgctcttttattttctaaaagggaaatgggttaataaattagccaggtgtggtggcatacacttgtaatctcggctactggggaggctttggtgggaggatgatagcctgggtgaaagagcaagaccctgtctctaaaagttaaaaaaaaatggtttcaaaaaaaggcaacaaaatatatttaggatagtccccatcattggtcttcctcactgattaatctgtgctgatttgtcctttcctggactgtgatatatctaaagagtaccttttaaaattagtatccagctgaaataataatgaaaatgctcttttgggaagaatggaaagaaaataaagacagtgattgattaagtcgtatggaacattaatctggtttgtggacataccattttggcagactacaaagtatgaggcaggcaagctgagcatcgatagtggagaaaatacccaacctggtgcccctagactagacacggtctgagagtgagtctctagtcaaactttagtatttgtaatagcctaatatgaacatgtcacttcatctcatgtcctgtttttccatgagattctttgttccatggccttctgattcaggggcaaatatagtaaagcaagagtactttgcatgcctttttttcaagtattttgtgtcttactcttacattttactctgtcccagaaccgaaactttcattgttttgatgctttcccactcaaccaagacagcttcttggtggttctaaatggtcttcctcaagtacctttttttgttgttgttgttcagacggagtctcactctgtagcccagactggagtgcagaggcgtgatctcagttcactgcaacctccgcctcccaggatcaagtgattctcattcctcagcctcccgagtagctgggattacaaggtgtgcaccaccacacctggctaatttttgtatttttagtagaggtagggtttcaccatgttggtcaggctggtcgcgaactcctgacctcaagtgatccacccgtctgggcctcccaagtaccctttatcttcagtgattgtttctcaagaccaacgttttctaagttgatggttctgcttaagtttttgcttcagatgccaagctgggtttgcaggttgactggtgagagtatttcctgggttaatgattacagtaattccatttgttgtactctctttccttgaaaatcgtcatcttttctctattttattcctctgtaggttccaaataagtttcgctatccattctactatgagatgtgttggtatgtgttggagcgctatgtgtactgcataaccaaccgttcccacctaactaaggaatttcagaaagagtccctcagcatgggtaagtattctgcctataggagctttgaagacaccgcttaggtctgagggtgaggcccgaaatactcagtaggctgtcactcaatatgttcttggttttttaattcatctacttggaagtaccaaattcatcactggaattgaataccagttacctacccagatgtgagttaatggccaaatgaaatactctggatctgatctttgtctgagttgctattacttagctcctcaagaaggatgatcaagccggacacgctggttcacgcctgtaatcctagcactttgggaggccaaggtgggcgaatggcttgagcccaggagttaagaccagcctgggaaacatggcaaaaccccatctctacagaaactacagaaaattgggtaggcatggtggctcgagtcccagctgctcaggaggctgaggtgggaggatcactggaacccaggaggttgaggctgcagtgagccgaagatcatgccactgcactctagcctgggcgacagagtgaaaccctgttgcgaaaaaaaaaaaaaaaaagaaagaaagaacgatgatcagttgtctaatatgctttttgtttttgttttagagacagggccttgccctgtcgtccaagttgaattgcagtggcgtgatcatagctcactgtaacctcaaactcctgggctcaagcaatccccctcctgagtaactaggattacaagcacacaccactatgcccagctaattcttactttctgtagagatgaagtcttgctctgttgcccaggccggtcttaaactcctggcttcaagctgtcctcctgcctccacctcccaaattggaattacaggtgtgagccaccactcctggcccggttgtctaatgcgttttattgtataaagaatggtctttggcacaataaaaactaggaatacatcatcagaataacctgttgtattctaggcactatactaagcaatttacatttatgaaattcttattattacctgagagataggtattattatcctcattttacaaatgggaacattaaggttcaaggatatttaaaaacttgtccatgatcttaaagttaataagtgacaaagctacagcttttagagtctgaccagcttggttcagcttcacagcttaaaccaggttggtcagactctgcagtttatgctctttatctctgtgctttcaagtttccccaacatctatcagagaaatattttaattagatgacagtgtagtttcagtatacatttttagactcttatatgtctgaaactggtgaggactcaacaccataatatcctgggatcacatgttcttatggaatctttaatccaagcaagatattttttgctttagcattttacttttactgcataattttactcatagtttatattctcagttgaaaataaaaaatgggcctggcacggtggctcacacctgtaatcccagcactttgggaggctgaggcgggcggatcatgaggtcaggagttcgagaccagccaggccaatatggtgaaaccctgtctctactaaaaaatacagaaattagccaggcgtggtgttgcgcacctgtagtaccaggtactcgggaggctgtggcaggagaatcacttgaacccgggaggtggaggttgcagtgagccgagatcacgccactgcactccagcttgggcgacagagtgagactccgtctcaaaaagaaaaaaaaaaatacatctaggccgggtgtggtggctcacacctgtaatcccagcactttgggaggccgaggagggccaatcacgaggtcaggagatcgagaccatcctggctaacatggtgaaaccccgtctctactaaaaatacaaaaaattagctagacgtggtggcaggcacctgtagtcccagctatttgggaggctgaggcagaagaatggcgtgaacccagaaggtggagcttgcagtgagctgagatggcaccactgcactccagcctgggtgacagagcgagactccgtctcaaaaaaaaaaaaaaatacatctaatagagctaggcactgtgatgagcacctgtagtcccagctagttgggaggctaaggcaggaggatcacttgagtccaagagttcaagaccagcttaggcaacatagtgacacccccatctcaaaaagtaaccaacaaaacacatatagaccaggcatggtggctcatgcctgtgatctcagtactttaggaaaccaaggtggaaggcacacctaagtccaagaggttgagaccagcctgggcaacatgaccagaccctgtctacaaaaattttttaaattagctgagtgttggggcacatgcctctggtcccagctgtttgggaggctattgtgggaggattgcttgagcccaggaggttgaggctgcagtgagccatgattgcatcactgcactccagcctgggcaaaagagtgagaacctgtctcaaaacaaacaaaccacaacataaaaaaaaaaaacccacataataatcatacacatctgttaaagcatggaaagaaagtatattgtactgttcagttgttatcgtaggatggagggataagggatgacttatttaccgctttgcgccttcttgcattttctaaattataaaagaaaagactggtgaacatttatcactgtgttttgactatcaaaatcttccttttcaaaaatagtcactttgttttgttacttatgttgttagaatttcaactccaaagcttgattttaagaccaaaacttcagacaaaaaaaaaaagttttttggtttttttttgtttgtttttttttgagacagggtctcactctcttgcccaggctggagtgcagtaatatgatcgcagctcactgcagcctcaacctcccaggctcaagcagtcttcccacctcaccctccctagtatctgggaccacagtcatgcatcactatacccagctaatttttttaatgtagagatggggtctcactatgttgcccaggctaaaactattttttaaacatacatgcttcttagtgtcttctcttttaaaaggtaatgaaataataatcccagattcaagctttaacttgaaactgactttacaaccactttgataagtaactgatttctagtacacagttcaaagactaggtcctacccaaactttaaaaaatccaattgactattacctaggtgtcctcctaggtcaggatcctgtttctacctgttaactgtgattttgaacagtggacaaatgggttggaataaagatagaccatttttttaaatgtggtaattttgtcatttatagcctcaaggcccctatcatgccacctatttctcttgctgatcacatggcagagtgaaatgttcttactgcattttttcttcatattggtagatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaaggtaagggtttgatgtgttacatgacagctactgatccagctatggcagtcagcttccagattcagagggagaaaatataggaattttgggtgatctctggttcagtcagagagaagttaatatgcatgtgtgtttgttattgctgctcagtgttttcattactagaatgaggttatgtccctgttttgaaaatactaacatttatgtgttcattgaagacttataaatttagtcttaaacataggtttcaggctgaccccaaaaataaagtgacccaaagaaaatatttatataagaaatgttacattaaacttaagttaccttgagataaaactcaggacaaaagtgactgataggagtctcatcctaagcagattgagagaaatgaaattgttctatgctgggttaacgttgagtagctttagcctctttagattcaaatttatctagcatcaagacttaaatacattgggaaaagcatcattttaaaataattcatcccattgctttatcaagttttatgtttatttattttttaattatactttaagttctagggtacatgtgcacaacgtgcaggtttattacatagacatacatgtgccatgtcagtttgctgcacccattgactcgtcatttatgttaggtatttctcctaatgctatccctcctccagctccccttcatattgtatatttttcttaaggaatccagacttgagcttttttttttttttttaattttaattaattaattaatttatttgagacggagtctcactctgtcgctcaggttggagtgcaatggcaagatctcggctcactgcaacctccacctcccgggttcaagcagttctcgtgcctcagcctcctgagtagctgagattacagacacgtgccaccatgcctggctaatttttttatatttttgatagagatggggtttcaccatgttggccaggctggtctcgaactcttgacctcaggtgatctgcctgcctcagcctcccaaagtgctgggattacgggcatgagcctccacacccaaccttgagctatctaaactggaggaaattattttaagtctttcctcctaagtaacaattaatgtgaagaccaagaattgtaaagctggaaatagcaattttatttttaaatcagtgtttggaacaatgggtatgtatattagaaagctaatctacaagttgtaatgttattttgaaaacctcacatagattattttaagctacttttaagccattttataaatttaggggggccaggcacagtggctcacacctgtaatcctagcactttgagaggccaaggtgggaggatcacctgaggtcaggagttcgagaccagcctggccaacatggtgaaaccccatctctactaaaaatacaaaaaaaggctcagtgcgatgtctcatgcctgtaatcccagcactttgggaggccgaggcaggtagatcacgaggtcaggagttcaagatcagcctggccaagatggtaaaaccccgtctctactaaaaatacaaaaattagctgggtgtggtggcagacacctgtaatcccagctactcaggaggctgaggcaggagaatcccttgaacctgggaggcaaaggttgcagtgagccgagattgcgccattgcactccagcctgggtgatggaagtgaaaccctgtctcaacaacaacaacaacaaatccattggagtagtttaactaaagtagctaaataaggagatttgaggtgaaagggtggtacaatggtataccaaaggaaaaagtagaaagatttgggttaaatattaagcagagtcagcaagaagagaggggagttaagaagagacatctaaagaggaggcttagcattatgaaaagtgtccggagatagcttgcttgtgtttatcagggaccactgaaaaacgtgactgccatcactggctaagatatagtggcagaggccagagcatgaggaacaagtagccagtgagatgactacacaggccgacagtgtttgaattctccctccagagacttgtccacagcttctcgtttacccaaaaccacagtcaaaatgtagctgacgtcagaagacaacagatttagattccagctctgcaggtgtagtttcacttaagatcaaatagattaattattcctatatttgatcagttatgctaaatctcagaaaagatatagcaagcttagagcttgaataccttgagaatctaagcatcactcaaaagaaaaaagcattagattgggtagctgctgaatcactgcacagctggggactttcaagtgctagaaaacttggtgcttatagcactgatggctatacttcagtgggggacaaagctagtacagtttacccttcctgcagagaaaggaattgtttgctgttgtaacctatctggctttcaggaataattagtagaagagatgaggggaaaagtggtagatgagatattcataatattccaaggaaaaatagtgcatttcagtgctgtgataaaagggctttttttaggttctaaggcgttgaagaacaagtcatagaatatagagttggaagaggattaagtgaaaaaataggacattaaaaagtactgacttgggctgagcccagtggctcacacctcttgtcctagtgctttaggcggcagacgcaggcagatctcttgagaccagcctgggcaacgtggcgaaacctcacctccacaaaaatacaaaattatccaggtgtggtggtgtgtgtttgtgatcccagctacgtggaaggctgaagtgggaggatcacttgagctgggcaagttgaggcttcactgagctgtgatctcaccactgcactccagtctgggcaaaagagtgagaccttgtctcaaaaagaaagtaggccgggcatggtggctcatgcctgtagtcccagcactttgggaagctgaggcgggcggatcatgaggtcaggagatcaagaccatccttgctaacatggtgaaaccccgtctctagaaaaaatacaaaaattagccaggtgtcttggcgggcgcctgtattcccagctacttgggaggctgaggcaggagaatggcgtgaacccgggaggcggagcttgcagtgagcccagatggcaccactgcactccagcctgggtgacagagcaagactccatctcaaaaaaaaaaaaaaaagaaaaaagaaaggaagtattgccttaccggtaaactggtaaagctatcagcgtgtgtatgaggttctgtttgggaggggttgtgggtaatgttgactcttgaaagtgtacataggtagaatagggttttcctactatgagaatttttttttttttttttttgagactgagtttcactgtttttgcccaggctggagtgcaatggcgcagtcttggctcaccacaacctccacctcccaggttcaagcaattctcctgcctcagcctcccgagtagctgggattacaggcatgcaccaccaccctggctaattttgtatttttagtagagactgggcttcttcatgttgttcaggctggtcttgaactcctgacctcagatgatccacccgcctctgcctcccaaagtgctggaattacaggcgtgacaccgcgcccggctgcttttttgttttgttttgttttgttttgttttgtttttgagacagagtcttgctctgtcacctaggctggggtgcagtggcgccatctcggctcactgcagcctccacctcctgggttcaagtgattctcctgtctcagcctctgagtaactgggtctacaggcacgcaccaccactccagctaatttttgtatttttagtagagacggggtttcaccatgttggccaggctggtcttgaactcctgaccttgcgatccacctgccttggcctcccaaagtgctgggattacaggcgtgagccactgcgcccggccaagatatccttaacatttctaaaattggaaagttgtattcttgatatatgttgaataaaaaggtaggacatgtaacagtatgtatagtaccatcccattaatgtaagaaaaagtgtatgcgtatttgtgcattgcagaggaatctaaaagggtacatcccagcctgctaatagcagggcacaataggatagtagtagtcaactggaagaatttgtggtttttttgttttttgagatgaagtcttgctctgtcacccaggccgaagtgcagtggcgtgatctaggctcactgcagcctccgcctgtcgggttcaagtgattctcctgcctcagcctcctgagtagctgggattataggtgtgtgccaccacgcctggctaatttttgtattttcagtagagatggagttttaccatgttggccaggctggtcttgactcctgacctcaagtgatctgcctgtctaggcctcccagagtgctaggattataggcatgagccaccacgcccagccacaatttgagtttttaatcagattgttgtttttgttggtatttattttggtgataaagtagttcttaatatatatgcatatataaaagaagctttttatataacaatatatctggcggcccagctcacttaataaagcaaattcaatattgttgaatacttttcgactttcctgttttctctaaacattttgataagcctgccaatcatactttgtgacttttgggtaagttactaaatttatggaaacctattttctcctctataaaatatctgtgagattgttgttaaaattaacaagattagtaaaatacttaataagcagtgcattattacagccagaaaaaagttagatgttacaaatctatgaaattcacttattccaccgctctgaataatgcctgcctgctctgtgtcaggaatcagattgaatgttaaggaaactatgcagacatgccgtggtcctagccctcaagagccttagagttcagtggcaaagcagatataaaagtgggctaagaaataggaaataagtgcagtccaggtttgtaggtgcctggcatgacacagggcacagagaaaatgagtgagagtggcagagtctatcctgagggaaagagatgttccagtcttaattcaccagctaataaactttcctgttataggatataaatttattactacaacattatataaatggtaaaaactctgaatttataaattggaaaattgttatttgtgatgtaataggctactgatactcttatctaagaatcttaacattttattttggaactatgatctaaaaatttatgttaggccccatcccaggagtatgatgagattgaagcagaaagggttattgttgcaaataactccagaaatactaattaggaattctcttcagttgataatttgggggttattctgacactaatagaactagaagaagacccagtatagttagctcttattccattaagccagatttttaaatgtttttaaatttttctttattattattattatcattattattattattagcaacgaggtcttgctgtgttgaccaggctggtcttgaatcttgaactccttgccttgagcaatcctcctgcctcgacctcccaagtgctaggattacaggcatgagccaccttacccaaccaactcagctttttgtttgtttgtttgtcctgggtccaggcttacagatttttttttgtaaagcaacctaggccagatgtgttagctcatgcctataattccagcactttgggaggctgaagcaggaggatcacttaaggccaggagttcaagaccagcctgggcaacatagtgagactccatcttcaaaaaaattaagaaattagctgagcatggtattgtgcacctgtagtcccagctactcaggaggctgaggtctaggctgtagtaagctgtcatctaccactgcactttagcctgggcaacaaagcgagaccctgtctgaaaaaaaaaaaaatttatatcctgttataggatatatttatttatacaaataaaactttatttgcaatatttactaacaagatatttgtaataattcatacattcttactgaatagaaagttttaagtaatgtaactcagttatgaggcatatatgcttaaagttacatataattattttaaatattttccttatattcttgtattatgtaatgtcatggtcttagtaattcttatcttttttgcctatcttttattctcaattagcaggagggggtaaagttaggccttgtttaatttgtgatttggaaacttactgggagtgagtttcctagtgcccgatgtgatttttttcctttcctggtggcctctagaatttgcacttgctgcaacttgaacttacgtttgttttaaagtaatatgttttctcttaagtattcatactttactatctctataatatagatagcactgaagatcaaaataagcattttccaagaagacctctcaatagctagatcactgttaaggaaagcctttcaaacaaaataagccgattgcagtgggtcttgagtcttaagatacagtgtccgggagaagtttagggttaggatgaccatataagcatttccaggagaagctcagccgagagcacaaaagtctgtccttcccctggtaaactactataaaaataacatatgtagcccctggcagcaaagctccagactttagaaagcctagttagccactaaatctgtaccagaaactcactcaaacaactgtcctggaaataaataagaatgcttaagagctagatgcttaaatcagagcatctgcaaaaaaggcaagttatacatttgtaagggtctaaaagtcacataaaaatcacattggctctaaaaaagacccaaactgtttctgctaagtatttgattcctactcaggttctcccatgctgatgtttggtacactgtggatcactagaaactcaaccagagtgtgcaccctcctttcctcctgtagactgaaaggagtgtgtgttcagtctgagcttcatcccagctggggatccggggatcagggtttgttgtgcagaggtgtgagcaatacttgtcagtccgagtggctgtgagaaggcagtgaggtgtcttgacaggatgcaggactggctgcttcatctggggaatatcaagaatgagacaggcaaacagacttgaatagaaatggaaatccaagagtacaatactggtattctgagggtaggataatcttacaggcagaggagactgctggaattgggagaatgtgtgttccctggcttcctgcaccttgtttagaggcaggagggcaaagtgtgttgtgcctcagttgtttgacttggtcacggtggaactgctgcaggattgctgcgcagacatttctagtactgtactgtgggggtggagtccttgtcagaatcagaagcaggcatctgttttagatgtagttgatgttagccgtattttattgaatatctcaatattggctgacatgggccatttctgaaggttttttggaacacataggcagattctggattgtgggctgggagcaagtcagcgagggcaggtgaagcaggcagtgtgccggagagagaagataactcaagaggaactcagctcctgtgcctagttcatccagagaggcggaactttgggcgaccccctctacttgctgagaggggagagagaagtgtgtgtgcagtcagccagagagctctggcagtaacagtggtaacagtgagaggtgaccctgaggggaagggtgtggactgaaacaaggacaaatgtgggccaaggtgcctagtgtagcccgcagaatgagttaaagccttccctttggctggcgccttcagaagtctgccaccgggagccctcagggggctggccctaggttctcctattgcagtggtggtgggagggagacagggcgggggctgtggctgagctctcctccctggcagggcctcttccaatcgcgaggaagaaagcagttgctgaacacaccccctcccggctctgcagcagaacggctgggccctctgcctggctcgctcactctcgctcggctccccctcctgccatcttccgttgcaaagcatttctgggagctgcatgtgggtgacgcagcagcattgttcgcaggcacaggaagccgcggctgagctgaagggctcgagaaggagcccagagcgctgcacgctgctccctctgggtagtctgaagggtcagagctggactgccctgccctatgtgctctgggagattccagaatattcaagtaaatccggattttcccagaggcagaatatctaactccttcaggagaacttccagtacagaaaacaaaacaaagacgctggggaaacttcaccaagagcctcggcagctccagagcgacgggaaacgaaaggtcagggggtcgatcggcaaaccctttctggtttggggtgcgtgtaactatagggacttttgtctcagtgaagaggcaggagaaactgcctgccgggcgagtccaggacaatgctatgttacttcgtgttgcttgagccgtcattgcacttgttccctcacctggtgggatgtgcttttgaattgggttggttggcttttgagaatcctttccctctctgcccaggcaccttctgttctctttcccttcctgtgatctgtagggtgtgggcttgtgtttaaatgttctcccgaatgcctggagccgagataggcgtcagcctttcccgcactccacccccgctctcctatcccaaaccccctctagtgaagggtggtggcttctttatatggtttcttgtagggcctcagctggagtctgccttttttgatgaaagcagggcgtgcttggttgaatggccccagcaaaataaggcttggaaggaaatctgcatttccctccacacccacacataccccagtaactgagtcttgtatgtgtgaacagctgccaccccccacacacacaccgacacagttttccgcctacccttccctattccccacaaaaatcttgcaggtagaattagactgcttttggtgaacagttaagttccttttctactcttgaacaatcgcagatcttactgtgcagtctgttttgctgaaagtggaaagtccccgtttgtggacagctcagttcacttcagcagaggaaatgggcagagtcctactcttcgtcagtgcgaagtgggggaggggagccatgcactccctagcacacattttgaatggacctgaatttttcaccctagggagattaggagcccataccagagccttgtcccacgtggcaccacaccccgcctcttcacccccacgctgtatggtactaacagaaaaggatgccatagcaacttgaagtaaataaaacatccgcagatgaaatgagtttgggggaaggtgagaggcatctggagacttggcaaaaggggatcttagtagaggagcttcttggctatgagtgaaagggtctttctgagacccaactttgggatttggagcaggatccttaggttaagaatgaaaatacataaaagtcctggtctccgggacagagcacacaggattatgagaaaaattattagcaatggcccagacttgctaacctgtccaggatcagagtttagtgtttgccgaaacagttaccatcctgtacatacatacctagggtagccagaaaaggaatcatgtaacttgtctcccagatttattttgctgttggtgttgctttagggctcataaggtcagaagaagaaggattccattatactagaagatttgggtttcaggagtttctgtctaaaacgaaaagatttggccaggtgcagtggctcatgcctgtaatcccagcactttgggaggccgaggcaagcggatcacctgaggtcaggagttcgagaccagcctggccaacatggtgaaactccgtctctactaaaaatacaaaaattagctgggtatggtggcaggtgcctgtaatcccagctactcaggaggctgaggcaggagaatagcttgaacacgggaggcgaggcggaggttgcagtgagccgagatagcgccactgcactccagcctgagcaacagagtgagactccatctaaaaaataaaaattaaaaaaaatatatttgtttcaaaataacagtcaaccagtgtgattcacttaagtggcattttctcactgtagcattgttcgtaagtcatttaaattttattggtaatgccatgagaacttttgcccctaagattgttcctttcccccatttagaggaataaaggcaaatagcagactctgtgggtgtgtgtatgtgtgtgtgtgtgtgtgtgtgtgtgagagagagagagaaagaaagagatttgagattgagatttctgtaatcagccttagaagaaaagagccctgggttgaatctgcacattaggctgtaccattcatctcattaattctgtattagcaaatcatttttatgccacttggttcacatctgagaaatgaaggcaattacctgataatattcactaactggtgtagaaaagtgaagaagcaataataaagttttactgtcatatgtagaactgtatgagaagtaacacttgtcaccacagtaagttagttgtttcagtgtgttagtataattagtacacaagtaagggattgggaacaaaggtgagtttgaagtcctttctgctcccccaccaccaccatccgcccccagtagagatgggtcttgctgtgtttcccaggctggtctcaaactcctggctcaagtgatcctcccacctctcacaggcatgagccactgtgcccagcctcaaagttttgataatattgcagcagcctaagtttgagttttctccttcacctttgatttatttgttttccagtgagtctctatatgaagggcaaatacagacagttgccaccctgcctcccttgctactcaagggtactgaggcagagtctggatgctgttcagggtggttggctctttgttcaccctgccctgatttttccttcttttccctcctacccttagattttgctggaggagcttgccaacagcgatcccaagttagccctcactggagttcctatagtacagtggccaaaaagggataaggtaagaaactattttccttgatctttaggctgcttaagccttttgttagttgatcattaccattctggggaaaacaagaacaactagaggcagatggcttttggtgcattaatacaaactgacagaaaatcattattcagttctgttttgactcgtaggtcagggtaattggctatctttggaggtgacctctcttaacagaactatcaaactgggaggcctccctccagattcagatgccaaattgtgcatttgtgcatccgcttctatccttgtgaccagttactcagctatcttcacagatatgattgaaagccagttaaaataattacatagatatctaaaaggagcagagtttttctttgacgtagtgagatcattctctcaaaaatccccttaccttggactttgcagtgtggaatggaaaagagaagaaaggggccgggcatggtggctcacacctgtaatcccagcactttgggaggcccaggcaggtggatcacctgaggtcaggagttcaagaccagcctggccaacatggtgaaacaccgtctgtaccaaaaatacaaaaattaagccaggcgtggtggcatgcgcctataatcccagctacttgcaaggctggggcaggagaatcacttgaacccaggaggcagaggttgcagtgagccgagatcgcaccattgcacttcagcctgggggacaagagcgaaactgtctcaaagaaaaaaaaagaagaagaagaaaggaattactgtcagctaataaattgtcaattatgaattttcatgcctcttcagtttagatcctgtataatttttttccccatactgtcctctatcaaggttatgtattaaataaatgatagcattctgatcctggctgtgaatttggcaaataaatgaggcttctgtttgttgttccctagctgaaacttgcaaagccatcacattccaggggtgtttaggcagaatataaaggtatggagttgaacagtatatttagagaatcacctcctcgtccctagtgggaggagtcctgcttggcctctgcttggccacaggtgactgccttaaaacaattcagtcatttctggttgttgagtattttgtgtcagaaaagtgtttaagatatggtaagaaattaaagtagtagaaaacatggtccttgtccttgaaaaggtcaccagcagggtaaatgcaaatgctaagaaatgtgttccacacttaaatattattgaagtgtctgctatctaccagttcgtatgcttgaatttggagtactaaagaaatgaacaagactagtttcaccttaagggagtttactgtcttctttaggagtataatctgagaagtcaggatgaggaaatattggagggctcctggagtgacttcggtacatggcacttgatacagaaagctcagggaggggtgaatcttaacagctctgcaaaaagaaagggaagcagctgaattagtaggccaaagggctaggacaagggctggtaaatttttctgtaaaggtcaagatagtaaatactttaggttttgtacaccacacagtcaacaatttctcagttctaccatggtagcatgaaagcagccattgattggccgggtgtggtggctcacacctgtaatcccagcactatgggatgccaaggcgggcagatcacgaggtcaggagattgagaccatcctggctaacatggtgaaaccccgtctctacaaaaaatacaaaaaaattagctgggcatggtggtgggcacctgtagtcccagctacttgggaggctgaggcaggagaatggcgggaacccgggaggcggagcttgcagtgagccgagatcatgccactgtattccagcctgggtgacaaagcgagactctgtctcaaaaaaaaaaaaaaaaagcagccattgataatacatacacaagatgagttgtgtgtcaataaaatttattctagaaacaagcagtgggcagatctggccatagtgggccaagccccaggctaggtatgctaccatgtaatcttctaccctatccagtcttaaagcaacctgatatatttgacctcactgctttctctttccagcttaaattccccactcggccaaaggtgcgggttcctaccatccccattacgaagcctcacactatgaaaccagctccacggttaacacctgtgaggccagctgctgcctccccgattgtgtcaggagccagacggagacgagtgcgatgtcgaaaatgcaaagcctgtgtgcaaggagagtgtggtgtttgccactactgcagagacatgaagaagtttggggggcctggacgcatgaagcagtcctgtgtcctccgacagtgcttggcagtgagtgatctgctgggtaaagaattttggggaggggtggcagtgccaaaggaactgaaatacatatagtgtagagttaaagagacttcagagttggaaagaaaaggtttatactctctttttggctttattttgtaccttttttccccaggtttagatagaaggtatctagtactaaaaatccgatttaatctttaggctttacctaattttcaaacaagagattagcatttgaagggcaaatcattgctttctttcccctcttcaggtagattagaaaggaccggggaggccaagtataggccaactgaaaataaactagtctctggtgcccaggtggttgagtcctcctcttccccagtcatttttcctacccaaaacctccgttctctccaccctgcctccatgcttccaggtgtttagtagagaattataggacccaaatctcccatcttcagtttaagggaaactgaaatgataaagatctgagtcagttctcttggattctatctttgtcctcttgtagcccagactgcctcactcagtcacatgttccctctgtggagaggtggatcagaatgaagagacacaagactttgagaagaaactcatggaatgctgtatctgcaatgagattgttcatcctggctgcctccaggtgaggagagctatgaggggttcctgaagtctcagctaatggagtgagtgacacaacagaatgggacacttgtgatgggagtgccagcatccctactgtaggccatcagctctgtggtcacataatgcagtggtctaacatcagcccttgattcatatatgtacaatgtgtcaggcactgcgttagaccctgaggatagaacagtacacaaaatagacccagttcctgtcctcatggagcttagaatctggactctggattgggtatgtagagttcccaggccataatggaactgcatggtgtgttttgggatgcctcaagcctttaggcatctctgatacatacttcagtgtacctctggatattagttcctaagggagagtgaggataataatatcagataacatttaatgagtgctgagtctgtatcagactcagtgcagagctaaatagctttaaaaaaaaaaagtaataaaaagtaataaattcagatctcagcctcagagattgagtccagcatgggccttgtgttccaaaagctcccctactgatccgaattgtgcagcctttgtggagaaccactgtttccttggccttcttagaaagtatcagctaaaatcatgactgtcgcctgacagtgataataagacactgtcattcatgagaagcagcccaatttcagaaaggttaaaatgtgaaaagtataccttttatagatttttggtttttttgaatactatatagtagcaaatctataacagaaacaatagtaggtcagtatttggaggcattaagcatatgttgaatgaagaaccgggtttttgttttgttttgtttttgagacatagccttgtgttgttgcccaggctagagtgcagtggcacgattatacatttattcatttaatgttataaattattttatatatatatatatatatatatatatatatatattttttttttttttttttttttttttttttttttggagacagagtcttgctccttttgcctaggctagagtgcagtggcgtgacctcgtctcactgcaacctttgtctctggtgttcaagtgattctcctgcctcagcttccctagtagttgggattacaagcacgtgccactgcgcccagctaatttttgtgtttttagtagagatggggtgtcaccgtgttggccaggccggtctcgaactcctaacctcaagtgattcacccgccttggcctccaaaagtgctgggattataggtgtgagctaccgcacccagcctgattcttaggatattttaacagcattacaatctttttttttttttttttttttttaagacatggtctccctctgttgcccaggctggagtatagtggtgagattttggctcactgcagcctccatcttctgggttcaagcaattcttctgcctcagcctcctgagtagctgggattacaggcatgcaccaccatgcccagctagttttgtgttaagtagagttggggtttcaccatgttggccaggttggtcttgaactcctggcatcaagtgatttccccaccttggcctcccaaagtgctgggattacaggcgtgagccaccatgcccggccaactttacaatcttaaaagtttgtttgattaattataacttggtgaagatgtaaatggtgcatattacatctattaacatatctcaaacccaaagaattggtgaaatagggtattaattccatgatgatgataatggctaatacaaagggttttctgtatgccatacctttgttaaattctttacacaatgaataatcttcaccacaaccctataaggtgggttttgttgtatctctggcaattatattgttgtatctctgtgtattagttcctgagggaaagtgaaggtaataatatcagccaacattttacagtggagaacactgagtcacagagactagagcattagtccctaaacccaagctatcagaacctgtgccgcactgtcaagatcaggttcagcaccattggctatttggggctggattgctcacagtttttctccctttatggaccaatgttgttgagaaatgagtaactcttcccaactgtgttattgttggataaaggaagcttgagagacaggcttttaaaaacatctctgtcttcctatagatggacggagaggggttgcttaacgaagaattgccaaattgctgggaatgtccaaagtgctaccaggaggacagctcggagaaagcccaggtaaaggaaccttatcagatttgcactgtgacagaaaggaggcatcaaatgtgggggattgctacacgtttgcctttgcattagtgttcacacagtttctctgacctaggagattatttttgtttggtttggtatgtttttcctttggttaatttttagtattttctttgttagagtttgtagcattgtgttttgtattactaaatgttgttccacttgggatctgcaaattcctaaggtccttttatactctggggccctacaaagagaggaaccacggctgggctatttgaggagagaaattaggtgagtatgatccctcctgaggaatgttaactagaggagaggcagtggcctgaggcagccagtgagtgcagcagtgtacttgagcttccagttaagcaggttcacatttttgtcatcttcacttttgtggcctggcagaaagccctgccctgcccatcccacatgcccaaatgtgtcatgtggaggcagcccctcccccagagaggaccagtgctatgaccttggcccagaggagctgaggttgctgaccagtggttgccaataatgtcaaagggccaaaaggactgtacttactcaggctgacaaggcaagaccagctgtggacacctacaggaggagatggctttccaagtgccagtctttcaaggacccttgcacgggagcagggaagggggcagaaaggaattttcttactttttatttcttcccacttggatactaagatagttgaatttttcaatctatttgtctttgagggcaaggatttttgaagttgactagggccaaagttctccttagttcttgcactagtgacctttacatgtgtcttcattagtgatgttgagtgtttgcatctctgctgtagcagatgtgttgttggcagatggctgtgttttagtattaccttctaatacattggaaaaggtagcacccaaaaggtggtcattttcttccaaccataatgataaaaaaatgtaaggaggaaaaggagcagagaacagggttgttgcttagagacataaaatgtctccttgcaaaaaacctgaactactgatacggttcctagtggaacatgtttactgggctttgtcatagcatagtcatagtgggctccaggaaaagacaagtatctagagagcacaaatgccacagataaagttgggggctcttgtgggattcctcaccataatcctgagtgaatctctctgtagcaacccagtttctcagagaggttcttgttatctgctttattattcacgtgggggttggagtggaagacgcagcctggtggagtcaaacttagactgtggtagagctagaagccaatggtgtttaccattgtcagactcaggatcttagttcaaatggtatatgtgggctttttccaccatgaaacagaaatacgtctcttgggtgaaagaggtaagtcagagacgcaattaaaaatggtcaggccaggtgcagtggctcacacctataattccagcactttgggaggccaaggcaggtggatcacttgagcccaggagttggagaccagcctgggccgactctgagggaatgaccccctctccaacgtgacctttcttctctctggtcccctgagagcaagggaggtccaccctgtcggttcagagggtttggaagaaaggaagcactgatgttgcttttctgggcctgttttgcagaagcggaaaatggaagagagtgacgaagaagctgtgcaagccaaagtcctgcggcccctgcggagctgcgatgagcctctcacgcccccgcctcattcacccacttccatgctgcagctcatccatgacccggtttccccccggggtatggtgactcggtcatcccctggggctggccccagcgaccaccacagtgccagccgcgatgagcgcttcaaacggcggcagttgctgcggctgcaggccacagagcgcaccatggtacgggaaaaggagaacaatcccagcggcaaaaaggagctgtctgaagttgagaaagccaagatccggggatcgtacctcactgtcacgctacagaggcccaccaaagagctccacgggacatccattgtgcccaagctgcaggccatcacggcctcctctgccaaccttcgccattccccccgtgtgctagtgcagcactgcccagcccgaaccccccagcgtggggatgaggaggggctggggggagaggaggaggaagaggaggaggaggaggaggaagatgacagtgcagaggaggggggtgcagccaggctgaatggccggggcagttgggctcaggatggagacgaaagctggatgcagcgggaggtctggatgtctgtcttccgctacctcagccgcagagaactttgtgaatgtatgcgagtgtgcaagacgtggtataaatggtgagcagggattcagggggtcaggaattaggggtatgggagtaggtggcaggttttccatatgagaacagcatgcaccttggcatctgaaagcctgtggggtcttatgaggagtgaattgaccctttttcccaaactttgggtcctgtttaaagatgtagcctgttgtacccgcagatgtcattagggaactggccatttgcctcctggccctgctctatactttcccatgtctcattgttatggggagggagactgatttgcgggatagatttgtagtctgtgataaaacttgagagtcttgcgggctgaaaatttcctcctcaagtcagctgaactcatcacatgttggttgagagcctatgatgttctagtcactcttctggtgctgataacacagataacctcacttaagcccctgactcaattacctctccattcagtgagagaagtgggcatgcttttcaagatgaatttgaaggtgcttaacatttttcttcagttttaatgctcatccccccaaacctggatcagaattccctcttccagcaagcagagtccagttttgaagcttccttaatgagagctaccatttcttcttaagttggacagacacttgggggaaaaaattgctagtgatgatgaacaaggagcttcccattgggcattgttggtttttccttaaactctggtatatatttactctaggatatatcctttttatctgggtcacacacatcctattacagtagtgtggtgtcctgaccaatggcattcactcaggaactttttagaaatgtcaactgtcaggaccctcataggcctcttaaatcagaacctcttgggtgggcccagcagtctgctttaacaagcgctcctccaggggactctgatgcatgctcgagtttagagcagcaaaatctgctgtattgtcagcagcttgcttctgccatagaagcttcatgtgccactggtaaaattgtttcagtctctaaatagaccctattctttgcaaacatgagtttatttcccaaatctgaattaatgtatagtgtatctaaattctccttaatatttctctgtctagggctaataggactgcttggctctacctcttggttttcagggcaaggcacatcagattcccgttatgtgctgtctctcttcccctgccaaccaggctggggggcaggggctataaaatattaaattgaagccagcatgttgtggtttgtggcctgtagatttgtagactgcagtggaaagccaggcctatccctttcagttctggtctggcctggctagaaaatgtcaggatagcactgaggcagaacttgagggtgagagaggactctgtaagcctgataaagagcctcttttgacctgatacagtaatgggctgaaggcagggtgaattgtggatgtgctgagtagcaccctgcatttcaggcagctgcgagtgattgacaagggagggaacggagcaggccttcttagctttagacagtaagaagtctagaaacttcaagaggctcccttatatacacttcagcaggaaccatgccattttaatacagatgaaggggctatagactgttgcttgctatgggtccctaacaactgttgtgttctcaaacactccagaataaatcagggtaaagtggtcaagttatatactatcaacatgtaggtttgcaaagcgtctagttgttgtagagttcaaggcaattttttgcctattctgtgaggcaaaaaatgataaggtgtgatccctgtacacttgtagaagaacgagcctccaggtactctgcttttcccagaagccataagcagcctgtgatgggagctccactgatcaagttaatgaaggcgagttctcttcccttctatcacaggtgctgcgacaagagactttggacaaaaattgacttgagtaggtgtaaggccattgtgccccaggccctcagtggcatcatcaagaggcagccagtcagccttgacctcagttggaccaacatctctaaaaagcaactgacatggctcgtcaataggctgccaggtaagtgagcagccctgccgctgtctttccaggggcccagaagaagcgggcaagaaaagttgcattattggcagtgcttcttagcatcactggagggcagtgtagggcagcagtcccatgccattgttgcttagcaagaggtttacccagggccatcttaagtgtcagtctcccaggcagcactctggactggcaggccaatcactgcaatggacagcaaagagaacggaatcagtgttgctgccagccctgcagttctcctcagcataaccactaaagaggaaatttgagtcagatgttactttggtcagctccttataagcccttgttctcttcagcattttgagctcttagaaagacaggaagtcactccttcttgtattgctctggtgggaactaagcaatcaatttaccactaaagctagaagatgtagtataggataccatggaaatctttgagctggatgactaaaagattaggcatagtccttctctcctattagactggaagtttgttcactttgctcagatcgttacggctctgagtatgctgggaaacagtgtattattacatgtctcattccatccattgcaggactgaaagacctcctcctagcaggctgctcctggtctgcagtctctgccctcagcacctccagctgcccccttctcaggacccttgatcttcggtgggcagtaggaatcaaggaccctcaaattcgggacttgcttactccaccggctgataaaccaggtatgctctggacctgacttctctgtgcttgtcttggggtagctttgtcttccaaacagacctcgtcttcagaagctaaggtagtctcagatatgacgctgtggaagaatagaagagcacaaaatgaaaacagaatgatggactgtgtacaagaatagggtaactataagcagataactacctacaaacaatggagtaagtccattttgtgagttggtggagtttggggcccagagagtgtaagcctgaaaaagtctgagaaggctttatggtggaggtggagtcaaaagctatttgcatgatggtctagaaaagtgtggtggtattggaaggggaggagcattctgcacatagccttttgctgtgtgcatgaggcataatctagcagcttgagaagaaagaaaacttgtctggtttcctagaaactgcctacacccagtgctcacaccctgaaggcatggctgggtgtgggcagttctacttaaccccttcaagggggcctggccagcaagtagctgttgctgcctggagccttgaagctggattagagaattgagagttttgatctaggctcttctcttgcctgtacaggtcaggacaatcgcagcaagctccggaacatgaccgacttccggctggcaggccttgacatcacagatgccacgcttcgcctcataattcgccacatgcccctcctgtctcgactcgacctcagtcactgcagccaccttacagatcagtcctccaatctactcactgctgtcgggtcttccactcgctactctctcacagagctcaatatggcaggtatgccgctacagttgttcataatcagcggtgccccctgcctccagccctccctggaacttgatcagtaaaccagaatgaccttgggtctgttgattgacccacatcagctcatttcttcacatctggacaaggacatggatttctatcccttttttaactgatgggggactgaggccttgagtagttaagtcggttgcctgtctgcgcagccaacatccagctggagtttggtcagccttgcagcccttgtgcttgttgtcatatggtgatgggagtgaggcagcagggtccctttggaggtgctgatggcacttctggtctctgagccaggtagttgtgggacaaagagggcttttgtttagcattttgaaggaaagacggctacaggaattgaatggcagaggaaagctgtgtgtatgtgagcactgtcattatgtccactttcccgacaggttgcaataaattgacagaccagaccctgatctacctacggcgcattgccaacgtcaccttgatcgaccttcgaggatgcaagcagatcactcgaaaagcctgcgagcacttcatctcagacttgtccatcaacagcctctactgcctgtctgacgagaagctgatacagaagatcagctaagacacacccagcccagattcaacaggaaaccgatcttcccctgactccccaccgaggagagcctctcctcgaccctgcacgggctctgaggccagcgtcacactccctctctgctctcctgtcccttgagcccttcctctacaggtggggcagagagggtggtggacaccaggcttatctgcctgctcctctccctcctaaggaaaagggagtagcagattgatctgaggggaaagcacaggctgtgctgtcgaggcgcctgctcgcttactcgcctgccaggaggccgggctctcagtttggggtgtttgtgcaaccttcatctgcactgggccctgtgcccctcctccccatccatggtccccagcagtgcctggttctgagcaaactcccagggaagaaaacggccctgtctccatggccaggttcttgtggtgtccagtgcgcgtctctcctccatcacactctcccggcttgcgcaggaggggccagcagccccaggagtcccagacccgtgccgatcacactggtgctgttgagatctcccaaacctcacgtccttaactgtgctctccctcctttcctctcccttgagcttggttctgcccagcactcgtgcttgttcacataattaggtttcccaccccagcctacccgacttacttgctagtctctatgaggtccttattgcacttattggggttgaagctcttcagaggagctggaactgtctaccccagggacacacccatttcgttgctacccaagtggattctgagacaggcaccatctccttgttccccctctctcttttgcctcccactgactgcccttttccatgtgtcttcattctgcctgaagaaggctttcccaggatgcacgtcctcagagggagcagcctatctcccccaagctggaggcggcagaggactgggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaagaaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaagggtttggttgtgttttttgtttttcggagaaatattgtaaatatatatttttttgttgctgatttagagtcaatctccaatgttgtgctaaaaagtttaaattaaatgtaagcattaaggggataagtcttatgctatctcagttgacacattgaggttattttgggccagagaaggaggaagctagttggactttgttttgttttccaaaagttctccactattggttttagagagagcaaggacatctttcctctgacacgtgggaatgggtgatatttgtgtaataaaatttttaaaagacaaaaaaagaaatagcctccaatgggaaatattttaatttaggttttgtttttgtttgggggtttttgtttttttaaaaaaataaaaaggctttaaaaacaaaaa

SEQ ID NO: 11 - DNA, 110812 bp, Homo sapiens
gccgcgcgcgagagcctcggcctggccgcgctgcgcccgccgccgccgccgccccctccccgcctgggccctaccgccgcacggccccggccccctcccagcctgccgctccggagagccgcccgccgaggatgcgacgcaccgcaggtcactggggcgcccgcccaacagtcgcgggccgccaaccgccggggctggggccgggaggccgggctgtgggaggcctgaggggcggcggggaggaccgcggaggcctgagggggcgggagcgccgggaggagtgggggcactgaggaggcctgaggggccggctcaggggctgggggaccgggaggccgggcggcctgagagggtcgtggggaccgcgaggaccgcggaggcctgagggccggcgggaggaccgggcggaccgcggaggccgggacgagtccgggcaggggaggggcggcggcctgcgggcggcggcggctaacggggccgggcgggcgggcgcggccatgttgggcccggccgggccctgcggctgcacctgtgcccggcccggccgaggcggccgcctttgttcccgcggcgccgagcgggtcgggccggcctttgtgcggcgcccccggtccggggcggccgcggtgggaggggcaggttggggtcccggggccggcgccggggccaggggtcgggccgagggtcgctttttgtttgcaggcggtgtctggcgttgacactcgcggcgcccgggcgttggtcagcgcggacgctcccccgggaagccgggccgcggtccggcccttggcaggtggaggcgggggtgagccgggtgtgggtaccctgctggggggctgcgcgccctcggcgtccgggcctccgcctgggatgttcccctcgccccaggatgcagattgatagtccttgaagcctcagtgcatgagatgggacctggcgacttaatggctggttttgctccactcacaggaaccgtggtttaaaatctcggcgtttaaaaaatgctggtcttaagtttcggtagaaataaaatggatgagggtattgtataggacccattgcagcacgaatctttctgtgcccacgatgggctttgacattcaagtggaaacatagtatcaaaactgatgtggtgacgttaatcgtttttaggtagataacgtgtattttgtgtgtgtgtgtgtgtgtgtgtgtgtgagagagagagagagagagagagagagagagagagagagagagagcgcgcagaccctgtgaagacaagactaattggataaagttcaggcctggctcaggagcagctcttcagtgctacccacctgcttcacagactttcaagccttgatttttaaatgagttaaacgccagcatcacgcatgggttatattcactctattttgtgtatttcaaatatcaacgtggaaaataacttaggagccatcccatttatgaacttgggacttaaactttttaattttcccaaaatgttttaagtgccctagttacgtatttaaatgtgatgagaacaacaatattttaaagagcagaacgccaacaacataaagcaaacaagttctgtgagcacagcctttccttgtgtacttgatgtgtgctctcattccccacaactgatggtggttcaaatctaaactgccaaatggagatgaagaggactcatgctttaagcacgattactttgagtcatttccttttctttccttccattttctcagccacccaaacccagcaaccttcagttttgggctgatggttggtagagtgaggacttactgcacaattttgagtttgtgtaagcttttgtgaagagctctgatctcagtacaaaaattgtcctctcctgactgcattaataccagagtctggcctctgattataacagtaaagattttattttaagagtatgaggtaattaactgagaatttgaaagaatgatggacaatttatcgtatctattcgtatgtaacatataaactaatataacttttggagccatgcacaacaaaattataaggtcagcaggctgcaggtgcgacttgctttgtttctatgcaatcagcttatccagggctttcaaaccagtacttgctgaagtgtgcggacccaaatgaagcattaagcagagtcctagaatgagtcaggaagataatctgaataggtagaagacaacccactcctcctaatcctgtggggcttacatgggtacagccttctgcctattcagattatcttctccttctaaaagtaatcaaatcttacaaagtttactcacatggcagaatgtgaactttttttgtttgaagattcagtgtaaaacatgcaaaagtagctggaattaggcttactaagctacaggattctctttaccaagcaagaacttaaaagaagtgctaagatggtgctgaagttcataatccaaacgtattttgtcctgtgctatttatttatttttagagacagggtctctctatgtggcccaggcttgagtgcagtggctatttcagaggagagcaatcatggtgcacttcagtcccaaactcttgggctcaagtgattctcccgcctcagcctcctgagtagtggttactacaggcacactcagccttcctggctctgccctgtcctttttagctgggcaagtgggcaaataacctttctaagtaaataattaatcagcagcaacagaagccataaggctttttactcatatattctgatctacgtgtttggttttgcctttttgtttttgttttgttttttggtgggctgctcatggccatagaatgcatacaactttggataagcattttagtcttctgagcctcagtctcttgttttgcttgattgtagtaagtgtgaccttgttctccaaatacgtggtaccatgtcctgactccaggcctttgtgtgggctgttcttgggtgtggactacctgccacctgtccttcctctttgagcataattcatggctttttaatggccacttgtgacctttctcccctgttgggttaactcttagaggtaggactctgtcattgccttgggcagcattgcctctgctggtgcattctcatggcatacactcagtaagtgccgaataaatgggtatatggcttagggtaaacaaacagcccattttaatgccgatatctggcctgtttgcctctctgttttgtaagtaatggagcatctgggagaagaagctgagtctagaaaggaaatggcttggctaaggtcactctgaaacattgcaagtatataagtccaacaagtagtagaacagatctgtactaccaccaagatggagcaagaaatctacctcgtcaatttctctatccttggtgaagataaaaaaatataaagtacacagaatacgaaagaggagatgacatgggggctttagaggattaggcttgtatttgtaaactgtatgatttgctaattcctttttaatgaatggttatttacagcgagtactttgggggagaaaaagacttgtgttggtaacccagggactctagcattttatatttgtctattggttgcaatattgctcttttcttttgagatagggtctcacctgttacctggtgtggagtgcagtggttcaatcatagctcactgtaacctggcactcctgggctcaagctttcctcccagctcattctcctaagtagttaggactacaggcagatgccaccatgcttggctaattttaaaattttttatggagtcagtcttgcagtgtttgggctggtctctgtaactcctggcctcaagtgatcctcctgccttggcctcccaaagtactgggattacaagtgtgaaccactgtgcccggccaagttgcagtatagctttttactttttttttttttttttttgggacagggttttgctgtgttacccaggttagagtggagtcatatgatcacggctcattgcagccttgatcacctgggctcaatcgatcctcctacctcagcctcctgagtagctgggacaacaggcatgtgccaccatgcctggctaatttttgtgttttatacagacaggatttcaccatgttgcccaggctggtcatgaactcctgggctcaggtgatcctcccacttcggccttgtgcctggcctgcagtatagctttttaaagaattgattgatttgattacatttggtttgctagttaaaaaatccagacagattggccgggtgcagtggctcacgcctgtaatcccagcactttgggaggccgaggcggttggatcacgaggtcaggaggtcgagaccatcctggctaacatgatgaaaccccgtttctactaaaaaaaaaaaatacaaaaaattagctgggcatggtggtggacgcctgtagtcccagctactcgggaggctgaggcaggagaatggcgttaacccaggaggcggagcttgcagtgagccaagactgcgccactgcactccagcctgggagacagcgagactccatctcaaaaaaaaagaattcaagacagattttggctgggtgcggtggctcaagcttgtaatcccagcactttgggaggccgaggcgggtggatcatgaggtcaggagattgagaccatcctggctaacatggtgaaaccctgtctctactaaaaatataaaaaataagctgggcatggttgcagtgcctgtagtcccagctactcgggaggctgaggcaggagaatggtgtgaacctgggaggcggagcttgcagtgagctgagatcgcgccactgccctccaccctggttgacagagcaagacccctgtctcaaaaaaaaaaaaccaagacagatttcaaattagttttgttttagtatctgctttcctaaaaccacctggccccagatgagttttcaaagcattttactttctgtaatacttagtggtttcaacaaaatatacaaggatagaaattgcagtgttggttagctgagtgatggcctcagctcaaaaactccagtagtggataggcacagttgctcatgcctgtaattgcagcactttgggaggctgaggtgggaggatcacttgagactaggagtttgacaccagcttgggcaacatagggagaccccatctctacaaaaatttttgaaaattagctgggcttggtggtgtgtgcctatagtcccagatacttgggtggctgaagtgggaggtcacctgagtccaggactttgaggctgcagtgagctgtgatcataccaccacactccagcctgggagatagcacaaccctctctcaaaaaacaaacctaaacacaaaaccccaatagtgagactaccctagtgggtgtgtagaaaaaatgctttttttttctggaaggaattggaacctcaatttttaagttgacttgagttggcactgagagagttgatgatgtgaattaaatttgttatgccgtttgctggtgcggtgggtggctcacgcctgtaatcccagtgctttgggaggccaaggcaggcagatcacctgaggtcaggagttcgagaccagcctgggaaatgtggtgaaaccccgtctctactaaaaatacaaaaaattagctgggcgtggtggtgggtgcctgtaatcccagctactcgggaggctgaggcaggagacttccctgagcctgggaggcagaggttgaaatgagccgagatcatgctactgcactccagcctgggcgacaggacgagattctgtctcaaggaaaaaaaaaaaattgttatgcttttagaggatctgtgcatgttagcaatgttcttacattttgatggttttcatatattttttgctgctatattatggaggctaatgatcagaaagcatttttccgactccggttttactgtcttcaggtagttctctacacactgccttgtctttctaaaatacagatgtcctatgtgtccccagtcttcagggggtgactctcactgcccattggggttcaagacgagtctctcactggctttctgactctcactgcactacttgttttgccctcatctcagttactcagctcatctctttctgccatgtttttcctctgggcctttgtgtggtcaatttttgttcctttcttctgcccatgtgcccccttaccccatgtgtttgggggataggcatgctttccctcttccttccttctgccaggtctcagcttgggccccacactgaatgctgtgcctgactcctgcctgttttgggaggctcttgtcttttccatcgtcacccactcccattctcattctgttccagccacacgggcctcttgcctgctctgaagccctgcagctctgctgcctccgactagtgcccttgttccttctttgacctggaatgctgtccccaggtatctgtgtggcttacccctcaccctccttcaggtctttgtgcttctccctctcgggcaccttctctgaccactgatttaaagtactctgttgtgaccaggtactattacagtttatctgtgatcctggtgctttatgaagccaagacgagaggatcactccagcccaggagtttgaggttgcagggaaccacgattatgccactgcattccagactgggtggcagtaagactctgtcccaaaagaaaaataaaatttaaaaaaagtattatatatatacacacacacttctgagacggagtctaactctgtcacccaggctggagtgcagtggcacaatctaggctcaccacaacctctgcttcctgggttcaagcggttctcctgcctcagcctcccaagtagctgggattacgggtgtgtgccaccatgcccggctgatatatatatatatatatatatatatttttttttttttttttttttttttttttttttgtatttttagtagagactaggccatgttggccaggctggtctcgaactcctgacctcaagtgatctgcctgtcttggcctcccaaagtgttcggattacaggcgtaagccaccatgcctggccaaaaaaactttttttaattattctgttgctatctggcactccacatctgccttagattttctccatagcacatacctccaacattccatgtgaattcctggctgcattgggtcatctgtgaaggcagggacttttttccttttgcttggcttgctgtcatgtcctcagcacctggaatggtacctgagtgactgtcaggcattcagtgactatttgaatacatacacagccctcagtacttcgtatgccttagggggcataatatgtcccagaaatggtgtgaatgaaggggagtggtgtgagcattttgccttgatgtggagttggaaaggtggagggccatgggctggtggcagaggtcacagaagagccttatgcaccattagcagggctggagaactgtgacttaaccaatgcacaggaggcaaggctgggaaggtgtggacaggtgggagagaatgagcagaggcagcattgcccggactgggccatagcgtgagagtggtgcaggagagggtccttggtccaatccttacagatggaaagattgggtagttgctggtactgttacctctctgtgaaccaggggaagggaaagtgggcctcgcttctgacctaccttatttccttccagaaggaagctctgatctcacctacctgcctaaaaatgtgtctctggagcttcactgtttgcttagaagagaaagccctagatcttgagcatggcatgtggttcctgcctgtctttcctttatgtatctatgtgtatatatgtaaatatatacaacactttttaaaattattttattttattttattttatttttttgagacggagtctcgctctgtcacccaggctggagtgcagtggagtgatctcagctcgctgcaagctccgcctcctgggttcacaccattctcctgcctcagcctcccaagtagctgggactacaggcgcccgccaccatgcccggctaatttttttgtatttttagtagagacggggtttcaccgtgttagccaggatggtctcaatctcctgaccttgtgatccgcccgcctcggcctcccaaaatgctgggattacaggcttgagccaccgcgcctggcctacacacattttttaaaaaatgtgtattttttctttcctctgtgactctggccagtgatcctgcctgtctttctagcatctttgctggccagtcctttgtggttgctgtgagatctcatcatgctgcctgtagctcttgtgatgagccgtgccctgtcccatggatctttgcatgtgctgttgcttcttcctgagttgcctaattttgtgttgctgtggtggttttatggctcacctctcatctctgtgaagcctttccctatttctaccagaaccgggtgttgcagaccctgggcccatggcacttgtgtgtgtgtgtgtgtgtgtgtgtgtgtgtgtgttttctcccaagtttgtcatgcctttgtgagtactgggccctcttatgacagttagcatgttgcacaggctcttgccccattctcttctccaggttgtgaatttttcaaggtgagggccctttgatatgtcttcagtgcctaaatgtggaaagcacttagttaacaagtagagatagtttttgggtattattctgttttcctaatgatttttatttcataaaaatgtgaatttctagatttttggttaaaatatgtgttagaaataggaggcttctgtgttctttcccctccaaaattcggagttggtgtaatctttgtagagccttgctacacaaatctttcagcagcaaagcatcttcttctcattgaatcctcacagcaggaaattgaatcccaaagatgtcaagtaactgatccaaagtcacaaggctgtatgtgatgaagttagaactcctgcagggcctgacctctgattctgtaccctgggaacttactttgttttgcctcttggaaaactaacatacagcagtctatatgtgcatggaagactgagccattatatttctgccagtcagtgtggcagtgtacttctgcctgatatttcttcattcattgagtatcagttgtgtgccaatgatgagccaagacctatgtcctcgttcccatgggttttataggcctgtaatgggatgaaatggggagggacagtgagcaaaggtcatatctttgaaaaatctgtgaaatactcctgccaaaaaaaaaaaaaatcaaacctgagtccagtcaagctcctatgtttaacaaccaatctacaggaaatacaggggcaagagaaatactacagagttgccattggcaacactgagaaatgtgggaaactataagaccagtaagccatactcatcaacagggaaaaatgaaggggactgatgacaagagactggaggaacatggactaatttttattgtagggcttatctgtgtttgtgtcagatcagtttgttagagaaacagctgaatatcatttgtgatatttgagacagaatttggaacactgattatatttattattgaggaattatttttatttttagctgtgatagtgggtttgttatgtttagtaattcctcccttttagaggtgcatacagacatttactgatgaaatggtacatcatctagggtttgtgtcatgatcctatgggagagggagtaggttatttgtggttacatcaggacttcagggctggtctaggttgagagtggtatgggcacatgggttctaacttttttttgagatagggtccctcccggactcaaatggtcctcccacctcagcctcctgcgtagctgggacacaggcgtgtgccactacacctggctaattttttatgtgttttgtttttgtttctgtttttttgagacggagtcttgctttccatcacacaggctggagtgcagtggcgcgatctcggctcactgcaacctccgcctcctgggtttacgccattctcctgcctcagcctccccagcagctgggactacaggcgcacgctgccacgcccggttgatttttttgtatttttagtagagacggggtttcaccgtgttagccaggatggtctcgatctcctgacctcatgatccacccgcctcggcctcccaaagtgctgggattacaggcgtgagccaccgtgcctggcttgtttttgtttttaaatagagacagggttttgccatgttgcccaggctggtcttgaattcctcgactcaagcagtccttctgcctgcacctcccaaagttctgggaatacaagtatgagccacccctctgagccctggttctaattattctctccacatttatatgtgtttagaattcctcatcacacaaagcaagtcatgaaggaaagatctaggtgcatataatagggaggttatacctgacaaggctttgggaaagacttcctgatgggatagacactagagcagggagcagagagcagaacggggattgggtgttggctccatgagggtgggggtgagtatcagatggagggaagagcctgtgcagagcttctgtgatagagcaggaagaagctggtgtggctggagcagagggtgtcaggcaagttcttttaggtcctgttaagagcaatgtgaggttttaagggtgatggtgtgacatgaatctatttgctttggaaagaagattcctcagattgctctgtagattgagttggtgctggggaaggttccggaagagtgtgtacagaagcccaatctgtggtcactctgttcaggtgaaaacctttcctttgtccctgctttgggtccctgattggattggacagccctgtctccttgaaatgtggtgtggcctgtgatttgctctggccattggaaagtgacacgtaacttctgagtggaagcgctgagacacgtgctttatcgtgttccctttctcttgtttctgactgtggaaacaaacggatatgtactatgggcaagaaagaaaactttgggctgggcttagtggctcatgcctgtaatcccagcactttgggaggccgaggcgggtggacacgaggtcagaagatcgagaccatcctggctaacacggtgaaaccccgtctctactaaaaacacacaaaaattatctgggcgtggtggcgggcgcctgtagtcccagctactcgggaggctgaggcaggagaatggtgtgaacccgggaggtggagcttgcagtgagctgagatcgcgccactgcactccagcttgggcgacagagcaagacctctgtctcaaaaacaacaacaacaacaacaacaaaaaactgggttgagccaagtaacagttttgggcttgttactgtaccataacctagtctccagtggttctcaaagtctggtccccagactggcagcttcagtggcctggatgctagttagaaatgcacattttcatgtctcagacctactgcatcatgaactctggagtggggcccaacaatctgtgttctaatgtgtccttcatgtgattctgatgcccttgagttgagagctactgtctgaatttcctgactgataagtcaggaggctgttggcgtcagtcttggtgaaagagcttggtggttggccattcttgggattgtgggtgtggagaaaagtggacaggcctagctaggaaggcctctggagtaaaattgataagttgtgttgtttgggataaggagagatgaggggaagttctggtgccagtgatagccctaagtttttgtctgacagaaccagatggctagaggtgccatttactgtccagatagcattctttctgtgtgcatttacattaccttccatttcaggttcagaaacaagagaaagcccattaagaaataaaaatttgtggacttccttagctcaagtaacagtttctcaatgaaccccaccttgatacccctccccccatttaaaagtgtaccccctctgcagggctgggcgcagtggctcaggcctgtaatcccagcactttgggaggctgaggcaagcagatcacttgaggccaggagttcaagaccagcctggccaacatggcgaaaccctgtctctactaaaaatacaaaaaatagctgggcgtggtggcgcacacctgtaaccccagctactcaggaggctgaggcacgagaattgcttgaaccagaaggtggaggttgcagtgagcccagattacaccactgcactccaacctgggtaacagagcaagactttgtttccaaaaaaaaaaaaaaaaaagcgtacctcctccgctctgctgatcccaccttgtttgttgtccccatctgctctcccagctgtagtggaagccccatgaaagcagggctcttgtgtcttgtccatggctgcattcccagagcgagcagcatgtgtgggtgctcagcatgtgtgagctgaaggagctgcctagatggcgataagaagcgagtgtggcccacatggagctgcacgcaggagctgcgttgctgcctcttgttctctgttcatggttttctacacagtagcctaggatagaggctgaactgtcacgagagcatggagaagcttgtttaacttaagacaacttattcttccttaagtgggagagaaaaatgacatttcagcagaagcagcactacccacaatgaaaacttacaaaatgagactactgagaaagttgcagatataaaaattagatttttctccctttttttgtcggggaggagatggggtcttgctctgtcacccaggctggagtgcagtggcatgatcttggctcactgcaacctctgcctcctgggttcaagccatcctcccacctcagcctcccaagtagctgggactatgggtgcatgctactgtgcctggctaatttttgtatttcttgtagagatgggattttgccatgttgcccaggctggtctcgaactgctgagctcaagtgatctggcccaccttcgcctcccaaagcactaagattacaagtgtgagccaccgcaggccccttttgttcttttttttgagacggagttgtgccctgtcacccaggctggagtgcagtggcccaatcttggctcactgcaacctccagctccctggttcaagtgattctcctgcctcagcctcccgagtagctgggattacagacatgtgccaccacgcctagctaatttttatatttttagtagagatggggtttcactatgttggccaggatggtctcgatctcctgacctcacgatctgcctgccttggcctcccaaagtgctaggattataggcgtgagccactgggcccagcctcgttctttatctgcaaattgtatgctctatttgtagaagacaaattgggattatatatcgtgttaacagtttattgggttcttttcagttgagttctgaaatctgcaagtgtgtctttaaaattcaactgcctgggctgggcgtggtggctcacgccagtaatcccagcactttgggaggccgaggcaggcggatcacctgaggtcaggagtttgagaccagcctgaccaacatggagaaaccctgtctctactaaaaatactaaaaattagccaggcgtggtggcggcaacctgtaatctcagctactcaggaggccgaggcaggagaatcgcttgaacccgggaggcggaggttgcagtgagccgagatcatgccattgtattccagcctaggtgacaagagcaaaactctgtttcaaaaaaaaaaaataaaaataaaaaaaataaaattcaactgcctgtaactcctttgaaacaaatagtgctgcttgtttgtccactatctacctttttaggctgaatgcatgtctattttttatataccagtatgttcacagctgctataaggcatttcagcaaattagtggattaaatcagtaaagggcagaaacaagacattgccagtgccctatctcagacacctgcttatggatcagtggagcattattgagggctctctgctgattcagaaaaaataacaacagaatgaactgtgatcattgccttctcttttctttgcgagagggggccctggtcattcttgtaagttgataaaacttctgatatgttgataaaacttctgaggtaaaggaagtctgtctcagtggcccctgttgacatgtattttgataggaccttgtccttgctctgcatttctgcctctggggagtctcaagtggctgcttggggccacacatcatgctggagtgtggaggcatgctctgggtccttgagcctagctgctcttcatggctgtgccttcttggtgggtgcccctctcaggagctgttactgcctctcttggtacccatgcactgctcctctttgttaccacccagagatctctgcaccggttctgcagagctgccctgagtacaggtagttcctcactgctctcttccctcaggacaagttccaggcgcaggaatgatatagaaaaactgagttgtgtgagttccagcctagagtttatataaattttatttccagagatgtgcaatttgacacatcattatggcaaaattagcttaagtatttttaataattctataatcagaaaatatattttatgaataatttgtagaatacagaaaagtggaaggatacatacaactctgctctcaccaaccaaaatgttgaagcatattttctgcttatcttttcctttacgaaactaaagcgcgtccattgaagacgtatgctttgtgagtcttgtaatcaaaggtgacagtccctgctgtactccccttcagagttccatcaaggcaacctctgctctttcagctgtttcctttttttcttttttctttttgagacaggatctcactgtgtggccagggctggagtgtggtggtatgatctcagttcactgcaacctccatctcctgggctcaggcaattctcgtgcctcagtctcctgaatagctggtattacaggtgtgcaccactatgcccagctaatttttgtatttttaatagagacagggtttcactatgttggccaggctggtcttgaactcctggcctcaagtgattcactcatcttggcctctgaaagttctgggattacggacttgagccactgtgcctggcctttcagctgtttctatttatctgtactttaaaaagtaacttgcggctgggcgcggtgactcacgcctgtaattccagcactttgggaggccgaggcgggcagatcacaaggtcaggagatcaagaccatcctagccaacgtggtggaaccccgtctctactaaaatacacacacccaaaaaattagccaggcgtggtggcgtgcacctgtagtcccagctactcaggaggctgaggcagggtactcgcttgaacctggggaggtggaggttgcagtgagctgagatcgcgccactgcacttgagccttgggacagagcgagactccatctcaaaaaaaaaataacttgcttattttgctaattttagaacttccagattgatatatgttcaattctatctgtggaagatgatggaagatttagctttcttaacccgccccctcttacctcccatgttacctcccttcttcttcccaacattcccaatattgtggtggtttgatgatctattccagaacttagtggttgaaaaaacaacaacctgtatttgtttacagttttgtaagtgggacatggtttgccagggttagcttgttcctcctgctccatgtgatgccagcttgttggtactggctgtcaactgtgagagttcagtagggacttttggccatgggcttcattcttcccagtgtggtctatcctatgaggctgcttgggcttccttgcagcgtggtggctggttccatgagggaggaagtgagatctgccagtcgttttaaatgctgtagtgagaactgtcatcacttttgacatgttcttctttttttttaaatctcccttgctcagttatagcaagtccccacttttgccatgttttgttggtaaaaacagctacagggccaggctagactcaagggagtggggaaacagaccttcatctcttggtagagtgacaaagaattattgaccatctttatttatattttattggtgaggtcttgctcccttgcgcaggcgagagtacagtggcacgatcatagctcactgtagcctccaactcctgggctcaagcagtcctcctacttcaggctaccaaagtgctgggattacaggtgtgagcgtgagccactacacctggctaatttttgttggctgtttttaatctaccacacttttatagcaaggtttggtttaaatgaatataaattgttacattgttcagctaaatcatacactgtgatggataatatttacttgtatgactttgttttcctggtggtaagtttttctgttggctttattttccatgtatctgttactaattcagcctaaagtttttcaaatgaactgtataaaaagcctttgggatggtcagttacactagatctgtcagttcctttttttcttttttttttcttctgtgatgacctttctcccagagctgtcttcctgctccagattggactcctccctattctgctgcacagctgttcacatcatcttctgcgatggaccatctgttttttgcatctcatgtcttccttagtttaccttcatgtttggtgatacgtggtctgatagttatcttaaaatatgtgtgaggcaacgtttattaaggctatatggctgggtgcggtggctcacgcctgtaatcccagcactttgggaggctgaggtgggtggatcacctgaggtcaggagttcgagaccagcctggccaacatggtgaaaccagtctccactaaaaatacaaaaattagccaggcctggtgttgggcacctgtaatcctagctactcaggaggctgaagcagggagaattgcctgaacctgggaggcagaggttgcagtgagctgagatcaggccactgcactccagcctgggtgacagagcgagattgcctcaaaaaaaaaaaaaaaaaaaaaaaaaaagactttatatgccagagaatcatctgtgcatatcctcagctgatagcttggttgggtatatatcatttaggttggtaatgattttttcctcagaattttgaaggcattactttattttttaatttttaaattgtttttattttttttgagactgagtctcactctgtcacccaggctggattgcagtggcaatctcggcttactgcggcctccacctccagggttcaagcgattttcctgcctcagcctccggagtagctgggattacaggcgtgaacccactgcgcctggctaatttttgtatttttaatagagatggggtttcaccatgttggcaaggctggtctcaaactcctggcctcaagtgatccaccggcctcggcctcccaaagtactgggattacaggcgtgagccaccacgcctggctgctttattatttttgagcttcccatgtatattagtattttttttttttttttgagacagtctcactctgttggccagggtggagtgcagtggcatgatctcggctcacttgaacctccacctcccgggttcaagtgattcttctgcctcagcctcccgaatagctgggattacaggcacccgctaccatgcctggctaatttttgtatttttagtagagacgaggtttcgccattttggccaggctggtctggaactcctgacctcaggtgatccacccgctttggcctcccaaagtgctgggattacaggcgtgagccactgcgcccagtcgtatattagtattttttgagacagggtcttcttctgccactcaggctggagtgcagtggtgtaattatggctcacagcctctacctcttgggctcaagcgatcctcccacttcagcttcctgagtagctgggactacaggcatgcgcttccacacccagctaacttttttactttttgtggagctgaggttcttgctatgttgcccaagctggtcttgaactcctgggctcaagcgatcctcctgcctgggccaaccagagtgctgggattatgggtgtgaggcaccacgcccggccaagatttgacttttttttttttttgagtcggagttttgctgttgtttcccaggctggagtgcaatggcaccatctcggcttactgtaacctccgcctcctgagttcaagcgattctccttcctcagcctcccaggtaactgggattacaggcatgtgctaccatgcctggctaattttgtatttttagtagagagagtttcatcatgttggtcaggctggtcctcaggtgatccactcctgacctcaggtgatacacccgccttgacctcccaaagtgctgggattacaggcgtgagccactgtgcccagccgaccttttttttttttaattgagataaaattcacataacatttattgtttaaaccattatagagtgtacaattcagtggtgtttttggtatgttcagtgttgtgcaaaagttgctactacctaattcctaaacatttcatcagctcagtaaaaaactctgcactgttaagcagtcacttcctatcctctcctctcccagcccctggcagccattctacttctgtctttatggatttgcttattttagacattttacataaatggaatcatacagcatgtggcctttgtatctagcttctttcacttagcatcatgtttatctatgttgtagcataaatcaggacgtcatttctttttgtggctaaatatccatcgcatggatagatcattttgttcaaccattcatcagttgatagacagttgggttgctttttgctattacgaataatgctgctgtgaacattcttgtacaagttttttttgttttgttttgttttttgttttttttttgagatggcgtctcgctctgtcgcctaggctggagtgcagtggcatgatctcggctcactgcaagctccgcctcccgggttcacgccattctcctgcctcagcctcccgagtagctgggactacaggcgcccgccaccatgcccggctaattgttttttgtatttttagtagagacagggtttcactgtgttagccaggatggtctcgatctcctgacctcgtgatccgcccacctcggcctcccaaagtgctgggattacaggcgtgagtcaccgcacccggcctatacaaggttttttattgagatggagtttcactttcgttgcccaggctggagtacaatggcatgatctcggctcactgcaacctccgcctcctgggttccagtggttctacctcagcctcccaagtagctaggattacaggcgcccaccaccacgcttggctaattttctatttttagtagagacggggtttcaccatgttggccaggctggtctcgaactcctgacctcaggtgatcacctgcctcagcctcccaaagtgctgggattacaggggtaagccaccacgcccggccttttttttcttttgtgagacaaggtctcactctgtcacccaggctggagtgcagtggcgtgatcttggctcactgcagtctccacctcacaggctgaagtggtcttcccacctcagcttcccgcgtagctaagaccacaggcacatgccaccacgcccagctaagttttgtatgttttgtagagacaggattttgccatgttgtccaggctgatgtcgagttcttgggctcaagcaatccttctgccttggcctcccatagtactgagattacaggtgtgagccactgtgccccgcctacgtggaattgttttatatgagaacagaggttctaccatcattcagtgatagcagggctgaaatatatttcaggcagactagtgtgatatattagaaaatgagggtattttaggtatgtgtaaatcatatttgcaaacttgggttttccatttcagtcttttccgcccccggaggaatgggttggagcttggtccgtctcacggcctggctctggggaatgtcctgaatatctcactgctgtcctagggttgagacctccttctgctcagttggattcacggaattatcagagtgggctttagctgacatctaagccagtgggcaaggttggagcagtgaggcctactgtgtctgaagtgttaaagctccccagagaaccgggcacggtggctcatgcctgtaatcctagcactttgggaggctgaggcgggcagttcacgaggtgaggagatcgagaccatcctggctaacatggtgaaaccccatctctatcaaaaatacaaaaataaaaattagccgggcgtggtggtcggcacctgtagttccagctactcggcaggctgaggcaggagaatggcgtgaacacgggaggcggagcttgcagtgagccgagatcgcgccattgcactccagcctgggcgacagagggagactccatctcaaaaaaaaaaaaaaacaaaaaaaaacaaacaaaaacgaaaaaacgaaaaacctcaccagaaatgcacactagggcttacccagccccagtccaggaaggaatagtcttcctgcctccccattgccctctatgctttctcttttcctagcatatctactcttcctattttctgcctctctcctctagaatattagcacctcaagaataaggaaggcattttgtttgttgctctatttccaagtgctggagaacttgggtgggactcagtggttctttatttttatttctttatttttattttaattttagagatgggtctcgccatcaccatgttgcccagtctggtctccaactcctgggctcaagcgatcctcctgccttggtctcccaaagtgctgggattacaggtgtgagcccccacacccggcctgagtgagtgggttctgaatggtgactgttgttgtccatagccttccccctgcttctgagagtggagtccctcccctcatgttggagacctcccaaggtccatgtggtcctataggggctgttcagcctccctagccccttaacgtgtcaggtaatactgtatatattccatgaaatgtgaataattagttatataattcctaagcacttattttaaaaaacagcaatgtgatgcttaactcttcccacctctgttcctgtcccccttagaaaaccactgataactctttttttttttgagacggagtcttgccctgtcgcccaggctggagtgtagtggcctgatctcggctcggctcattgtaacctccgcctcgggtttgagcgattctcctgcctcagcctcctgagtagctgggattataggcgtgcaccaccacgcctggctaattttttgtatctttagtagggacgggtttcaccatgttggccagagtggtcttgaactcctgaccttgtgatccgctcgcctcagcctcccaaagtgctgggattacaggcatgagccaccgtgcctgtcctagaaccactggtaactcttaactggtaatttttgttttaacctctgtatttttatttttcacctgagtgctcaaatattttcatcttttttataatggtcatgttgcatttgtaattttaagaagaaaaatatttataaacgaggaattcttaggttattagtcttcttcctacaacagcacttctccagtaccaatctgattcctctaagtccgcatccccaggtttgacatctctaactctaatcccttccgttctttgtccttgtgattttacacctttcttttgtgaaagagatatgcatattaaactctcaggccaggctcggtggcttaaatgcctccaatcccagcactttgggagtccgagacgggtagatcacctgaggtcaggagttcgagaccagcctggccaacatagtgaaaccccgtctctactaaaagtacaaaaaaatgagccaggcgtggtgatgcatgcctgtagtctcagctactcgggaggctaaggcaggagaatcacttgaacccagcggcagaggctgtggtgagctgagattgtgccactggcacagttccagcctgggcgacagagactccgtttcaataaaaaaataaataaataaactctcagtctttgcatattgcaagatgtattttgcctctttttttgttttttgttttttttttttttttgttttgttttgagacaaggtcttgctctgtaccccaggctggagtgcagtggtgctttcttggctctctgcaatctctgctgcccaggctcaactgatcctcctgccacagcctccccagtagctgggattatgggcatgcacccagctgatttttgtatttttttgcagagacaagatttcgccatgttgcccaggctggtctcgaacttctgagctcaagcgatctacctgcctcgtcctcccaaagtgttggaattgcaggtgtgagccactgcacccggcccttgcctcatgtttgaatgataatttacctgggcataaaattctggacacttgtggtggcacgaggtgggcatttattttcccttaatgcttgcttgattgattgacagacagtcttgctctgtagcccaggctgcagtacagcggcatgcttataggttgctgtagcctcgaattcttaggcttaagtgatcctcctccctcagcctctgaagaagctaggagtagcttctaggactagcttctaggactgtaggtgtgtgtcactgtacctggctaaatttaaaattttttgtagagacggcgtcttactatgttggccaggctggtctcagactcctgacctcgagtgatcttcccacttcagcctcccaaagtggtgggattacaggtgtgagccaccacgcctggtgaagattttctgtttgtcctccatgttctgtcatttcaatacaatgtatctagatgatttgttttcatttattttgctcagaacatagggtgctcttttattcagaatatctaattttcctttcatctctggaaaatgtttcacctctttgaaatttgttggctggctgaggtggctcaacctgtaatcctaccactttgggagtccaggagtttgagaccagcctgggcaatgtggtgaaaccccgtctctacaaaaaatacaaaaattagccagtgtggtggtgcatgcctgtattcccagctaattgggaggctgaggtgggaggattgcttgggcccaggagttctaggatgcagtgagctgtgatggcaccattgcattttagcctgggcaacagaggaagaccctgtctcaataaaaaaaaaaaaaaaaatgaaaagaagaagttgtctttccctcatcctcccaagcctctccaactagaactgcattggaatgtaagctccttgaaggtagaggatttttgggggtatacgtaacataaaatttaccattttaactattttaaagcatttagttctatggtcttaagtgcattcacattgttatacaaccatgacactgtctccagaactttttcatcttctcaaactgaaactctgtcccataattccccatcctcctttttcttcccccagtttctggcactcaccattctacttcctgtctctatgtattctattctggggacctcatgtacgtggaattttacagtatttgtcttttttgtgtctgccttatttcacttagcatagtttcttcaagattcgtccatattgaagcagatatcagcatttccttccttttaaagctgaatactactccactgtgcagatagtctacattttggttatctattcatctgttgatgggttacgtctaccttttggctactgtaatagtgctcctgtgaacatggttgtacaaatatcttctggttcctgcttttaattcttttgggtagacagactgtttttcaccctgttttgttcaatgttataatcccaacacctaaaatcagtgtcttgctcatagtaggcactttatatttgaaagaatgaaacattcatgaatgttatgtcttaatttatcttacatggttttcatctctttatcagcccttttccttgctgattctctcagatttatcttctaatctattatatttttagctgtgcctggtctgctatattcaactcaactgagtttttaatttcaataccaatacttttttttttccaagtctgcaaatcatgaaaacagtaatttcctgttctcctgtagaagaccttccatactgtcccatgcctggctcctggaggatctctcactgctggtgggaggctgtgtttacctcaggggcatctctcagtggctctcccggggagaggggggctccccatgagcagttctcaggtttccctgcaggtcctaccagtgtcactcattctagacctgttttgacattttttggtctccggatttagccttcttaggcggaggcttggggttcacatttctcaagggtggctctgtcaccccagtggcctctggtgggtgtttgctgagggcccagccctgggctggctggtagaggggctcaggtgatgatgacagcactgtgaccacagacactcacctggtgatgaggaagtcctctgcctggtggtggcttcttttcctccttactgtttgaaagtacctgcaaggtgggtcctctgtcctcaggacatggagtgaggatgagtggtagaggctcttggccggggtcccacagtgtagtaagtggcagagctgggattctagtccagacagcagctccacacttggtgctcctaatcacggcagccagctgctcgccatgactcctctccttcgggctctgtgcaggcagcccagtcaggcccaagcccctgtcctgcacctcccttctgtattccggctgccaagccccagcacctaaaccctggggtcctgccatgggcagcctgcagcctatgaggctccagactgctgttcccttttcatttctagacctggagattctctctattgctttgcattaggcagtgtagctagacaaggtcttgctgagtctggcgtgcaatagtgtggtcacagctcactgcagtgtcaacctcctgagcccaagccatcctcacacctcagcctcccgggtagctgggactgtagatgtgcgccagtgtgcctggctaattttattttttgtagagacagggtctcactatgctgcccaggctcatctcaaactgctgggttcaagcaatcctccctctttggcctcccaaagtgctaggattacaagtagtgaaccactgtgcccggcctccctccctccctcccttccttcccgaactcttccattcctctccttccttcctttccttccttcccttctctctttctctttctttctttccttctttcttctcttttttttcttttcttttctttctttctctctcattctttctttctttcttttcctttcttctcttctcttttcttttctttctccttgccttccccaacataagaaagatagttaaacccgggtatggtggctcacatctgtaatcccagcactttgaaaggccaaggcgggtggatcgcttgagcccaggagttggagaccagcctcggcaacatggtgagactttgtacaaaaacacaaaaattagctgggcatggtggcaagtgccttgtagtcctcacagctgctcaggaggctgaggcaggaagatcacttgagcctgggaggcagaggttgcagtgagccatgatcataccactgcactccagcctgggtgacagagtgagactctgtctcaaaggaaaaaaaaaaaaggaaagtggtttgggctgggtgcagtgtctcatgcctgtaatcccagtactttgggatgttgagatgggaagatcccttgagcccaggagtttgagatcagcctggacaatatagtgagatccatctctacaaaaaaagggttaaaaagttagctgagcatggtggggtgcacctatagtcccagctactcgggaggctgagatgggaggattgcttgagccctgaaggatagaggttgcagtgagctgaaattgtgccattgccctgcactccagcttcggtggtagtgagaccctgtctcaagggaaaaaaaaaattgtttggcagggtacaggggctcctgcttgtaatgccagcactttgggaaggattccttgaagccaggacttagagactagcctggtcaacaagacaagatcccgtctctacaaaaaattttatttttatttttattgatatatttttgagacagagtctcactcaggctggagtgcagtggcgtggtctttgcttattgcagcctccacctcctgggttcaagcgattctcctgcctcagcctcccaagtagctgggattacaggtgtgtgccaccaagcctggctaatttttgtatttttagtagagttgtggtttcaccatgttggccaggctggcctcgaactccagaccacaagtgatccacctgactcagcctcctaaagtgctgggattgcaggcatgagccacctcacccagctgctgaacttcttgaatctgtacatttgtgtcttattaaattggggaacttttggaggaccactgttttctccaaatatttttgcctttttttttccctcctccttctgggtggaactccagaccctttaatattgttccacagatctgtgaggctctgcttcctttttttcccccttctttttacagtcttgctctgtaatccaggttggagtgcagtagtgcaatcatagctcactgcagccttgacctcttggactcaagcgatcctcctgcctcagcctcctgagtagcagggactacaggtgcacatcaccacgactggctaatttttgtattttttgttgagatgggctctcactgtcttgcccaagctggtcttgaattcctggacttgagtgatcctcctgcctcggcctcccaaagcctgaccacattccccttaaaaatggtttcgtggccaggtgcggtggctcacgcctgtaatcccagcactttgggaggccaaggcgggcggatcacgaagtcaggagatcgagaccatcctgggtaacacggtgaaaccccgtctctactaaaaatacaaaaaattagccgggcgtggtggtgggcgcctgtagtcccagctactcaggagggtgaggcaggagaattgaacccgggaggtggaggttgcagtgagctgagatcgcaccactgcagtccaacctgggtgacagagcgagactccgtctaaaaaaaaaaaaacaaaaaacaaaaaacacacttttttttttttttttgtccagcagctggaatctcttttcagttatttcataaactaggctgcttggaatcagcctggaatttgggcagagtttataggcagaatttgggactcccctctgagactctctccttgagatttcccccctcattttatagttgttacagttgcttcaaactctcctcagtcacacatttcaaaatggagttcacccagtgctgttccctttctttcaacagttggttccgtccattttctctctgcttttggttgctctcagttccttcaggaggtggttttttatgttttgtccagggttatagtttttaccttgggacagttggtatgatatgagctggaagaggaactgactttgatctacctttttaagaaattgtgcgggtcagacagaacacatttgtatgtgttttggtgttaaagagttgtccagagcacatgaagctgaactgggacttcaacattttttcaaggttttacatttgctctttttttcctgtctccttcctcagctgtctgcttttctgtggagactgcgggttgcagacaccagcagccccctattgctgcacgtcaggtgtcctccacctcagtactgtggacatctcgggccgcatagccctgttgcgcgggcatcctgtgcgttgcaggagatgcagcagcatccatgaccgcaacccatcagaggtcagggtccgccccctagtggtggtaataaaaaatgcttccagatgaggttaagtgtccctggggaacaaaatcctccccatttgagaaccgctgttctagtccacgggcatctctggtccttactgtactcagattttccctagtgtctgatgctattgatttctggcttctcagagggctgttgttggagcttgtgatggtgtactcctgagagatgccttcccagctggggcgggtgcctacctgtttcttattcctagctgtgttttggggctctggccccttcactagatgtctcagattagggactgtagctttgcagggaagaccccacaccagcatgctgcagcgagttaccttcctaaactgccccttctgcacgtgggcctcactggccagtgtggtgcactggcaaagtaacctgtgttgtggctcagcagtgttgttctcaagtagttaatcttcaggtagtagctaaaaaatgtgaccttactgctgtgttctttcttgtttaatttaggcctgaacacggaggggattagtggactgagataagaatactgggttgagcatagccagacctgactgggattgctttcacccttggagactcttggctttttgcttcttattttcatcaacctggagctaatcctgtgcttggagttggaatatctggttttagactttgctgaccaggtcatcttgggcacattctgagcctctgcctgatacctcagctgtaacaggagggattgggatgagctcttttcctgttagtgttgattttgcttttatgctattccctgttgtccttttgcataggcctggcattatgccagctgcctcacacatattagctcttttaagtatatgttggtggacaggtggaaatctgtgtttcagggatgattggcaagttaagttatgtgtccatggccacactgtagattattagtggtatgactggagtgtgctgtcttgactgactttcatgttcttcctttaaaaaatgattcctttttctttcagctttatcattttgtgattccgtgtaatttttgtgatactaaaactgccttctgtgacctgaattattataaaaacatcataaattgcttacaaagaaaatcagaccccacaaagctgtagaggtcctggcatacctatcctaggttttaaatgtaattgctttttctttcttttttcttttttttaataccatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaaggtatttaggagacgttgtgtaaggggtcatgtgaccttgagcagtgagcatggccaccctatgagggcacctgcacgagtactggggcgggcggagaaggtgaggacaggcctggtacttccagccacttgcctgagccctggctttgggttggagggtgggctccaggatgccctggcactgcctcctcagttctcagctggctgctgagccagttgagaggtctagagaggtgagctaagtgttcaagattcaaatggctaaaaagaggcaaagcttgtttcttaacgtggttctgccagtttcagagcccttgcttgacaacgtcaggctacactcttttcatggatctcatctccaaggtgttctttagcctgatgtggtcagtggagacaggctgggctctagagtgtgacttcttaagtctgcaccatctgatgagtgggaagcagagctgtgcagaggtgctcccgctgtccttaccctgtggtccagtgtccacttactgtctcctcagccaggtggtccagcagatggcctgcctccctgaggcctagggatgtgtcttttgcctcctgttcttggttcccagtgcagagcccagcacactgaacacaagcgaatgagtgtttccttatcctaacttgcgatggaaaggtgtggtggtgctgctccattctgcctggtgatggtgtctccacgccttcacgtggcactcgggatggccctgacactcggatgagtataagccataggaaacaaccaaggggccatggctttggcagaaggaaggaactcttgatggggcagcagtctctgttcatctggtggtctatagggtgttgctttttagttgtaactccttgaaattgttaaaataatgaagagctttgagggttaaaaaaacgttttttgattactcaggagctgtttagttctcgctcatgtaatggcagtggtgaagtttttaaattttatttatttatttatttattttgagatggtctctgttgtccaggctagagggcagtggtgtgatcatggctcacaacagccttgacctcccaggcttaggtgatcctcctacctcaccctcctgagtagttggaccacaggtgtgcaccactatatgcccagttaattttttattttttgtaggacagggtcttgctgtgttgcccaggctggtctcaaacccctgggctcaaacgatcctcccacctctgcctcctgaagtgctcgagttacaggtatgagctaccatgcccagcctacaaagattttttgaagtgcccacagcagtattgaacctcatgcttttgcttgggaagaggcctgtgcaagttgtcagagtcctagctgttttgttttgagacagggtcttggtatgttgcacaggctgttcacgaactcctgacctcaaacgatgttcctgcatcagagctggctttttctttctcctccaactgaaaaacaaaccaaacaaaaaaatctggcttttattcctagccatgtcccttggttttgttaaaacttgagtaactcaacctgaattttgactcttcctctggagagtggggtcaataaatgtaaacctgggttgctgtgcagtaatctggtagctgttctgaaagtatgtcaggcctgatggggtggctcacatctgtaatcccagcactttgggaggctgaggcaggaagattgcttgagcccaggagttcaagactagcctgggcaacatagcgagacccggtctctataaaaaataaaattagctgggcgtggtggcactgcctgtggtcccagctactagggaggctgagatgggaggatcaaaaaaacatgaaaatgtgtcatgtggcagctcatgccaggcttcaccagcatgcttatggcaaggttttgggccggcctcttcagcttacaggtgagaaaactgaggcctgaggcagtggaacaatttactcatgtgtatagtgctcttgagcaaggctagagattcacccttggagggttggggccatgctggctgtgcttatttccactggagagcagaactgtgagtggcttgtggggaggagtttttctttggtggaatgttcagccttaacctacccattatgttctagagatggagaaattgaggctcagagagccccaaggactcaaattacatgtgatggagccgagacttgctcctagtcctcctggtgcccttgccctcaccacactgggatggttcatgttggtgacacatgggctgctgagaactgatcgtcagacatgactggaggggcagaagtcagtatggatttggaattctgtgagaattccttttcgaccagttgaataaagtaccattaaagaccgtctattaatactaggccaaggaaatagatttatatagagatcttcaaaatgttgaacacctgctgtgtgctatgcactgtcctgatcctttagctgagagtgagagagaaattttttttttttttttttttgagatggagtctcgccctgtcgcccaggctggagtgcagtggcgtgatctcggctcactgcaagctccgcctcccgggttcacgccattctcctgcctcagcttcctgagtagctgggattacaggcgcctgccaccacgcccggctaattttttgtatttttagtagagacagggtttcattgtgttagccaggatggtcttgatctcctgaactcgtgatccgcccacgttggcctcccaaagtgctgggactacaggcgtgagccaccgcacctggcctgagagacaaaattttgatgaaacgatgttgaggctatcatctaaaacacagcaagggagcacactccatttttgggggtctgtgtgtatttggacattgtagcctggtgaatccttggtcttctggatacacaggtagtgattggatgtgttagtgtttgtcttctgttgttcattttcagattccagctaagaaagagtcttgtccaaacactggaagagacaaagaccacctgttgaaatacaacgttggtgatttggtgtggtccaaagtgtcgggttacccttggtggccttgcatggtttctgcagatccactccttcacagctataccaaacttaaaggtattgtgttctttgggttgtttttccaactttctcttctgcacttaatctttctcatctccaggcttctttcttactctttctaaatagccctgctatggttcatttttgcagctttacctaaagttagtgattgattcaagtgtgatgtgttgccatttctttttatattcaactcaaatatgtacttcatctgattgaattagtgttaagggacacatgacctttgccttgtataacttctgtttttatgatagtttattatttagttacgatgattgcttgtttcaggatgatttgcagcaagagtgttttatgctaagtttaagttgtaaaaatgtccaagtgaattttattaggcctatgggaagaatggaaaacactggaagtgatcatctttgtcttatgaagcttgggtagataaattgatttttacatggagcggctgatgtaacatattaagaatgtacggccgggcacggtggctcacgcctgtaatcccaacactttgggaggccgaggtgggtggatcacttgaggtcaggagttcgagactagcctgaccaacatggtcaaaccgcgtctctactaaaaatacaaaattagccggacgtggtggtgcacgcctgtaatcccagctactcaggaggctgaggcaggagaatcgctagaacccgggaggtggaggttgcagtgagccgagatcgcgccattgcactctagtctgggcaacaacagcgaaactctgtctcacaaaaaaaaaaagaatgttatatgtccctgatacagagcaaataatggttggtcaacccataaatgtgtttttagaggaatagtaaaagataatgtggtttgaggtttttctgaaagttcttctagagtgaagttggaatttagtttgagcaagttgcgatgtggcgagtgcggagttagaactgagcaagttagtgtcaccctgtgatctgatctgtgcaccctctggaagtgtggcgtctagagtcaggccagactaggccaatgctccagtccaatattgctgaccagtcagcctcttatggccccttggtggtccttgcgtacatgtccccttctggtctctggctggaggcctgagctcctgtgggggcagcgttgctgcccttgctatgagcttatgtctttgtactgccacctgcatggccaaaacaggcttgtcagctggctgtgggagcaggtggctgctaggaatggggtacagaggtgcctccctggcagatgtagatgttagaggggcaggctgaggacgaagaggactctgccgagtcctgggtgcccttgcctgagtcctgccctggcctcctgtcctgtgccatgtgtgctctgcaggagttgtggcagaagagcctatggcctggcttcagctctgtctccatggaggacctttggcatccttggcttgccagaattcggggattcctttccaaggggttgcgggaaccccagggtgtaccccagggcctctagactcggtcagtgtatgaaaaaataaatgctggttgagacagaagctgtctcccctttgtctgaggatggaccttcaagcctctgcagcccgggtgcaggcacacatgggtgtgtgtgaggggctgctaattctttctctgctttctaaaaccaggcatagtctccacacagcaaaccctgtgactcccatgtcatttgtttgtgtggcacacaagcagctcttactgatttcctttttagtgtctggggatatttacttatttatatgatgccatgtttagctgttagcctctcatgcctgtgaaactgaagtagtcttttgaaagtctccttgttcttcctattagggcttattacttttaatttctttttttggggatggaggctcgctccatcacccaaactggagtgcagtggcgcagtcttagctcactgcaacctgtaccttctgggctcaggtgatccttccatctcagcctcctgagtagctgggactacaggtgcgtgccaccacacctggctaatttttgtgttttttttgtagagatggggtttcaccatgttgcccagttggtctcaaactcctgggccccagtgatccgcttgcctcggcctcccaaagtgctgggattacagaaatgagccacagtgccgcagcccaacttatatatcattgcatcttttccctgccttggagttaagtaattcctgtagtctgcaacagcttctctgacattcagatatactgccatttttacttctctctctctctcttttttttttttttttttttttttgagacacagtttcactctgtctcccaggctagagtgcactggcgcgatctcagctcactgcaacctctgcttcctgggttcaaggaattcttgtgtctcagcttcctgagtagctgggattataggtgtgtgccactatgcctggctaatttttgtatttttagtagagatggggtttcaccatattggccaggctggtctcaaacctctgacctcaagtgatctgcccacctcggcctcccaaagtgctgggattacaggcgtgagccaccgtgcccggcctcatctctctttctttgcttgactccgggaccttgcactgtggctaagtgctttcactcttgtgcttatggcaccgttgtgttactctctgcggttgaggctgggactcaggaatcagcctgccagggtctagttagctggctgatcttgataatgaacttaatctcgctaagcttcagtttccctgtatatgaaaatgaggaagatgataccatcaccttcatggaaaggtcttaatgcagtgaccaccggatgctcgtattagcaattgtcattatcctcacttttacttttaaaacctgagtttttattgtttcaactcccattcccctggtttcttctatagctgcttcctgaaaaccttcatgtttgaccagttattaaccctgcagccacctagtgtttggttaattttaatacttttgtatctgtttttaagtgttttcatgtcctcaggtattccctcagttttcaaaacataatgccaaatgggtatacttggattctagctttttttgtgtatgtgtgaaatatttgatctatttttttaatctattttaaaaactttcaagtcaaagtaaaacagcacagcagacacctatcccctcatctagattctccaccttgaaacatcttgttctacctgttgaatctctttttttttttttttttttttttgtgacacagtctcactctgttgccaggctggagtgcagtggcacgattttggcaacctctgcctcctgggttcaagcaattctcctgcctcagtctcccaagtaggtgggactacaggtgcacgccaccacacccagctaatttttgtatttttagtacaaatggggtttcaccatgttggccaggatgatcttgatctcttgaccttgtgatccacccaccttggcctcccaatgggattacaggcatgagtcactgtgcctagcctccatctcttttgttgcatgatggctggtagctttcgtggcactgttacccccaaatacgtcagaacaaggacagtttccttattgactcagcaccagccgcatttcgggaaacatcacatcagtaacaagatctgttgctgtgctaagagcaggtgtagggcgtgtccccagcaggcccctacctgtctttttctgtacttcagggttgagatgcatactcggcatctggtggttgtgcctctttagcttctgctagtctagaacagcactcccaatccccaattcctcatgactgctttagctttctcatgatcagacctaggtcagaaaggccaggttggatctcacagttggaaccttgaaaggtagctttggccctttactaaagatctgtgtacagaagaagggagtgtcctgcaccagcataggctgggcagtggcctgcctcacctcagcagtcggcttctctaggaattattgtgggatgtagagtaggaggcacaagcaaacctacttcagaagactgataatatacttttttgtgtgtgtgaaggcattagagtataaaagatactgtacatttgaaaagcagttcagaaggagtcaagcctgggtagataaccctccaactgaaaggagattcagataatcttaaaagaaaaggggtcaaaggaagtgagcagaacaaagagaagtgagggaaggacagagtgctagtcagaccacatcaggaggagcttatgtgtcagctgacccacccctggtaggcgatgaccaccagagctctctgtggaaaggcacaggtccccattgtcactaatgagggacctgtgggctgtgcttgtagtctgtcccaacagtgtagcttttgttgttgttgttttgagatagggtcttggctctgttgctctgtccaggctagagtacagtggcacaatcatagctcactccaggctcaaactcctgggctcaggtcatcttcttcctgccttggcctcccaaattgttgggattacaagtgtgagccaccatacctgtccccagcagccacggctttagcagtccttgatgattcatcatggacttgttaaatggtaactggctattattgcactttctacattttagttgtcatttttctatgaaaatgagctcctccctaaaaaaaaaagagttatatattttagttcttattttcttaaatcctcacattgtcccaaatttgaccagtgggagttctattaagttcctttaagttgtatgcctttgacatgtccccgtcagcccttgagcacctctttacgttctggtacaacaagatgttccaggctcatcttgtactgtttttcccaccaccccccccaaccctagcatcagccgtttctcagagaaggcctaggttctttgagtacagaatagtatgtaggagcccaggtctggtcgctggttgtgttcattgctctgggagacagagtttgcaagggaaactctgtgcagtaggtctccaagcagtgctgagcccttgctccaagtggagctcttgggtccatttttgattctccaacacttggcctgcagcaccccatgatgagaatgagacagtgagtggtgagtgtcgttgttttggaaggacagggatgtgaagaagagatagctcctgccgtggagtgggctgagcatgggtcctgtgaagccagtacttttatatttttctatcctctattcctatcctttttttttttcttttcctggagatggagtcttgctcactcgtccaggctggagtacagtggtatgatctcggctcactgcaacctccatttcccaggttcaagcgattctcctgtctcagcctcccgagtagctgggattacaggtgcacaccactatgcccagctaatttttgtatttttagtagagctggggtttcaccatgttggccaggctggtctcaacctcctgaccttgtgatccgcccaactcggcctcccaaagtgctgtgattacaggcgtgagtcaccgcgcccggcacccgttaaaaaaaaaaaaaattatttatcatgcttgggatttatggaccagtttgaatccgtgtatcttagtaatatacttaaattttgaaaactgaggtataatatacatgcaaaagtgaacataactcataagctacagctcaatctagattcttttggaaatcaaaatttcctttggaaatcttaagttaatgaaagtcttaatagcattgttgtaatttacagcagcagaacctgtgttagctagtatctaccagggcacctaggtggactagcagcttttaggctcaacctttttttttttcgagacagtctttctctgtcacccaggctggagtgcagtgtcacaatctcggctcactgcaacctctgtctcccaggttcaagtgattctcctgccgcagcctcccgagtagctggcactacaggcatgtgtcaccacacccgactaattttgtatttttgctagagatggggtttcaccatattggccaggctggtcaaggctcaaccttttaagttggaaacagaagataactatatgttttagatattacactcactggtctctttaggtaactgtggtctggaatcaagtaattttctgttgtggagatttttgttgtcaccttttctgtgttatggaagggaatgttaggaattaaccctccttgctttatataggaaaaaaaatgcttctggcattttctaaaaatattgcaggtaatctggctttctcgtgtcttgtgctgtttgatggtattatcttcctactgatttgtttcttgcttgttctattacttgctgagagatgtgttaaaatctcccatgggattgtggatttgctgtttttctacttgtagttctggcagtttctgctttacctattttggggctctggtgccctccagagactgaactgggaaactcaggcatggtcatgcttgtcctttgtttcccagggagctctgtggtctcatgtcgttgtgactttgctcctgtgctccattcttggcttccgcagacacctggccttgtctgcatctttatggcttctcttccctccctggagctttatctctgaggcagccttgtctcttggtggggttcattttgcatgcatggaacttaacaggctccacaaaatctggagagaaactctggcttagttgagcccagagagtcacaaactacctgtagtctaatgggctgtgatggggaaaaaaggaacacagtacaaaattaggtaccaggactgttagtagaagccaggttctcttcgaaggggatgtaggtggggaggtcagtgacttgcatttttatacagatggtgattaatgaacatcagaaattgcataggaagagggccaggtgcagtggctcatgcctataatcccagcactttgggaggccaaggcaggtgggtgacttgaggtcaggagttcgagaccagcctggccaacgtgatgaaaccctgtttctgctaacagtacaaaaattagctgggtgtggtcccaggcgcctgtaatcccagctcctgggaaggctgaggcatgagaatcgcttgagcccaggagacagaggttgcagtgacccgagatcgcagtactgcactccagcctgggcgacagagcgagacgccatctcaaaaaaaaaaaaaaaaaaaagaaaaaaaaaaagaaagaaagaaattgcataggaagggaggattactaataacatagtactgggacaactggttaattattggtaaaataaaaacagtgagatattcacctctcaacttggaccaaaggatagttcctatggattaaagaaacccataaaaatagtagaaaattcggttatgttatccggtttctagatgggaaagaacttcagaatgttacactcatttattttacaaacttgggatcagattacaataatctcttctgctttttttcccacctgacatgtaaggagcatttatctgtgtcattatttataaacatggtttaattttatattgtgtgtgctgttacaggttttctttattataaaaatgctataacatacctgtattcattttcattactaagaaaagttcttacaaagttttaaagtaatggaagaagtcacaaatcccttgacatatccttgaatcttaggtattttcaaatcaaagaagtttgaacacttaaaaacaagtcaaattgtactgaaagattaatagtgaaaaatcatcccctgccttcctctctcctccccagaggtaattatttttatctctttcatcattttcttctacttctaatactttgatttctcatgtagacattttctgttaactttctatcatggaaaatgaagattgaactcttcagccattttctatttctttccccccattctccccatataattaagtcactatttgtaataaatgaaaaataagtgtttacataattttgactatgtaaatatcattcagtgaaaaaccaagttatgttctgtaattgcattttcttgtaaaaccttttgtttcccttggaattaattactgcctttcttttgaaatcatacactatgttgtccatacagccttaatttttttcaagtattcatctcctcatccttaaaactcatccttattatgaagttagtttctcctatttatatatttatatagttattttttctccttaaaaaaaaatgaaaacctgggtttgagtcccatcttccctttctgcttcttggaactcatcttttaaccctccttccttactacttagattttctttctttgtaaaaaagttgttttctctcatcttttcttcccttggagctctctcctagaatcttcctttttcctgcttgattctggtttgctagcactcttaaccttttgcactgcagtaagcttagactttctttaagctgctttccctagttatttacattgttttctgtagttctatgtgggcagcaagccacccaggtgccaaggcaagagactgaaggcacaggctgttccagtataataaagaaaatacttaaaataagaatagttatattagacatagaatatagacatgattatatatgaatattattaatcattagtttgtagcattactctttattcaaatattataacaatctctgttctacaattataacctaggaaaaaccaggtcatacagagataggagctgaagggacacggtgagaagtgaccagaagacgagtgtgagccctctgtcacgcccagacagggccactagagggctccttggactagcggtaacgccagtgcctgggaaggcacctgttacttagccgaccttggtctagcggtagcgccagtgcctgagaaggcacccgttactttgcaaaccaggaaagggagtctccctttccgtgggggagttagagaagactctgctccaccacctcttgtggaaggcctgacatcagtcaagcccacccgcagccatccagaggcctaaccgtctccctgtgatgctgtgcttcagcggtcacgctcctggtccactttcatgttccgccctgtacatctggctccgccttctagatagcaatagcagaattggtgagaatattaaagtctttgatctctctgagaaatgcatagaagaaataatgtaagctgtcccctctctctctctgcctcggctaccaaacagggaagggccccctgtctggtggacacatgactcgcttgaccttacctatcattggagatgactcacactccttaccctgcccccttgccttgtatacaataaataacagcgcagccagacattcagggccactaccagtctccgcatcttggtggtagtggtgtcccctgtgcccagctgtcttttcttcaatctctttgtcttgtgtctttatttctaccatctctcgtctccacacacgaggagaaaaacccacaggccctgtagggctgatccctacagttctatgctgtgttctttcttggttaagttttcttttttcctggaggctatttttggtatcttaagacagtttgtatgggaagtaaatttgagtccttgcagttcagagtatgctacttttgtttttgtgaggtggagtcttgctttgtcgcccaggctagagttcagtggcgggatctcagcttgctgcaacctctgccacttgggttcaagtgattctcgtgcctcagcctcccgagtagctgggactacaggtgtgtgccaccgtgcccagctcatttttgtatttttagtagagatggggttttgctatgtcggccaggctggtctcgaacttctgacctcaagtattctacccgccttggcctcctaaagtgctgagattacatgtgtgagccactgcacccagcccagagtatgctactttttttttgagatggagccttgctctgttgccaggctggagtgcggtggcacgatcttggcttattgcagtctccacctcctgggttcaagtgattctcccgcctcagcctcctgagtagctgggactacgggcacacgccaccatgcctgactaattttttgtgttttagtagagacagggcttcaccatgttggccaggctggtctcgaactcttgatctgaggtgatctgcccaccttggcctcccgaagtgctgggattacaggcgtgagccactgtgcctggcccagagtatgctacttttctatcttcacacttgattgatggtttgactgggtgtagaattttatgttgagaagaattcccctaggaattttgaaggtattactccatttccttctagcatccagagtttttggccattcttcacataatttgctattcttcacataccttgctattctatttcttgttccattaacttggaggctggcctttcacccaacccccagcagcttgaatttcagcagggtgtgccctgctgtggatgttgcagtgggacacttaggactgttttagttggagacttgattttgggtttattcttggagcttctctgtttctccagaaagcctattatttgggtatcaaacctcctagattgatcttacaggttgctatggaaataggtatttttcatcttaatttttttcttctttctgggagatttcttatcttccaagctttcttgttgaattttttctttttttctcttttttttttttttttttttttgagacggagtctggctctgttgcccaggctggagtgcagtggcgcagtctcggctcactgcaagctccgcctcctgggttcacaccattctcctgcctcagcctcctgtgtagctgaggctacaggcgcccaccaccatgcctggctaatttttgtatatttagtagaaatgggatttcaccgtgttagccaggatggtctcgatttcctgacctcgtggtccgcctgcctcggcctcccaaagtgctgggattacaggcttgagccactgcacccggcctgaattttattttcatagttgtattttagaatttcaaatatctctttgtttttctgtgttctcttttcatagcacacagggtttctctgttgggtatcttctcttcccttgccttatgtctgtggccctgcagagggccattcatttctgtgtgttttggattcattcatactggatgcttccctgggtccaggggttccttggtgctgggctcgtgtttaagagcacgacacttagagctgcctgcaaccatgggtggggaggcttggttatccaccctcctttgcattagagggtctgattggccattgaccacttaattgggggaatctccagaagactcactggagaggtttttcctctggagcacttcaggtcttcaggaaatatcctttgattcatctgggccagtgttctgcatgaggggacagggagtggtaactgcccccaccctgtgccagggagatccccctccctcctctcacctggcacagagatctgaccttttaacctgcttacctgtattcaccttctcatttgacttcagtggaatctggtacctcctttcttttattttgggcccgtctctttctttcctcatccccctggctgcactgtgggacgtggcttcttcctctcagctaagagtaagactagtgggcatctgtggggttactctgtggtctgagctgctctctgaggccactgatgctcctgtcactctagcactgtgagataggggggtagctagctggtaggtagcagggctgggatttgaacccaggttgtgtgatgtccgtatactgcctccttcactgcctctctcactcctttcttgcacatgtcctcttgtcttatttggtatctttttaagagggaataaaggagtgcatttagtcagctagctagcttttttctttttcttttttttcctttctttttttgtttttgagacagggtctagctctgtcacccaggctggagagcagtggtatgatcttggctcactgcaacatgtgcctcccaggctcacgccatcctctcacctcagcctccagagtagctgggactacaggtgcacaccaccacacccggctaatttttgcatttttcgtagagatgggcttttgccatgttgcccaggctggtctcgaaatcctgagctcaatctccctgcctcggcctcccaaagtggtgggattacaggcgtgagggactgcgcctggcctggttggctttctttcccattcaattttgaaccttatctgagtctcttgtaagttaattagtttccctctttggcatgtggcatggaagggataagaagtatagaatttgttttgaggttaacaggctcagacaacaccaagggaaacaactgcaaaatagcagtagatttgactagtttcatcccagattctaactttcattctctaacattttattttaaaaactaggtcagaaaaagagtgcacgccagtatcacgtacagttctttggtgacgccccagaaagagcttggatatttgagaagagcctcgtagcttttgaaggagaaggacagtttgaaaaattatgccaggaaagtgccaagcaggcacccacgaaagctgagaaaattaaggtgatagatgacccttcagtctacttttagaccagaaatttaatttttattctttaagttaacttatttttgttttgaacttatacttgctcgaaatattgtaatggcttaacaatctctttcattgttgacttttgcccaaggatgccatgttacaatatgataaagttcttttagagacacaactgatttttttttgctcatttgatgactctcagagataacttgttttagaatttatatatacacatatatgtacgtatatatgtgtatacacacacacagacagagggattaatgtaatgtgataggaattgatttctggtttaaagaaacaataaaggtattatgttgggctgaattctaaaattggtttttaaaagtttttatttctattattttttaaaatttttttgagatggagtttcactcttgtcgcccaggctggagtgtaatggcatgatcttggctcattgcatcctctgcccctccgggttcaagcgattctcctgcctcagcctcccaagtagctggaattacaggtgcctgccaccacgcctggctaatttttgtatttttagtggagacagggtttcaccaggttggccagactggtcttggactcctgacctcaggtgatgtgtctgcctcagcctccacaggtgctgggattacaggtgggaaccaccacgctggccaagttttttatttctaaaattatgtgaaaatgtaaaagtattcttttttttttttttttttttgagacagggtcttgctctgtcaccccaggctagagtgcagtggcgtggtctcgggttactgcatccgctgcctcccagttcaagtgattctcatgtctcagcctccctagtagctgggaccacaggcatgcactaccatgcctggcttatcttttgtattttagtagagatggggttttgccatgttgaccaggctggtcttaaactcctggcctcaagtgatccatctgccttgacacccataagtgctggaattataggcatgaatcatgtgcctaggaaaagtagttaacttttatgtttgtgtagtgaaacttacagtgtctcttttttttttcccagctattgaaaccaatttcagggaaattgagggcccagtgggaaatgggcattgttcaagcagaagaagctgcaagcatgtcagtggaggagcggaaagccaagttcacctttctctatgtgggggaccagcttcatctcaaccctcaagtagccaaggaggctggcattgctgcagagtctttgggagaaatggcagaatcctcaggagtcagtgaagaagctgctgaaaaccccaagtctgtgagagaagagtgcattcccatgaagagaaggcggagggccaaactgtgtagctctgcagagaccctggagagtcaccccgacatagggaagagtactcctcaaaagacggcagaggctgaccccagaagaggagtagggtctcctcctgggaggaagaagaccacagtctccatgccacgaagcaggaagggagatgcagcatcccagtttttggtcttctgtcaaaaacacagggatgaggtcagtactaagttgtgtttcatgctagcaagtttcagaatttgaggaacatcccttcagtgcagaatcatctgtttctcagcattatcaggagactctaacatgagccttgcatagattttagatctaataaataagtattagggaacagccattctgacccttgagggaaaagatactcgacttgcactctggggtcttaaaatatccttcctaatgtggataagaagataccgagaacaggccaggcacagtggctcatgcctgtaatttcagtactttgggaggccaaggcgggaggattgcttcagctcaggagtttgagaccagcctgggcaacatggtgaaaccccatctctacaaaaattagccgggtgtggtggcacatgcctgtagtcccagctgcttgggagactgagacaggaggatcccttgagtcctggaggcaggaggatcccttgagtcctgaaggtggggtttgcagtgagtcgtgatggcatcactgcaccgtagcctgggtgacagcagagcgagactgtgtctcaaaaaaaaaaaaaaaaaaaaactagcacagagggaagtgggtctcaacaggctgcgctttgcttgaagcgtgtggtcatgtccttaacgtgtgactccaggttagcactttctccagcagtctgttctgaagcttccagtgcaggatatgctcatctgtaaagctcattgtgtccactggcactgagggtgttgatttatttccctgacatttaaaagggtagcaatgtgattaagacatttatataattttcttaattgtttgcataaaatgcacagtctgttagtacataataaaggctgtaaagaactgaaggagttgggttccccacttcccacttttggttatgttacttggagtggatcatattctcatgcttaaaaggctttttttaagtgttcattttaattttacttccataggaattttccattcagtagtctaaatctatgtggtgattaaaggtatcaaaaacaatagtgttggccaggcacagtggctcacacctgtaatcccaacactttgggaagctgaggcgggtggatcatgaggtcaggaatttgagactatcctggccaacatgatgaaaccccgtctctactaaaaatacaaaaaaaaattagctgggcatggtgacgcgtgcttgtaatcccagcttctcaggaggctgaggcaggaaaattgcttgaaccagggagtcggaggttgcagtgagccaagattacaccactgcactccagcctggcgacagaatgagacgccgtctcaaaaaaaaaggaaaaaaagtctgtcttcaaaaaattttccatgaatctttaaccagcatgtattttgtggcaggcagtgtggcacaataaggagccatgagtagttcaggcagagatgcataaatgggtgactgtgagtattctaataaatctactggacatgatttttttgtccctatatgggatctggaaattctgccagagaaaggcatttgagtgatgccttcaagagtggctgggcgtggtggctcccgcctgtaatctcagcacattgggaggctaaggtgggcagatcacctgaggttaggagtttgaggctagtctggcctacatggtgaaaccttgtctctactaaaaatacaagaattagctgggcatggtggtgtgcgcttgtaatcccagctactcaggaggctgaggcaggagaatcacttgaaccgggaggccacagtgagctgaaatcatgccgctgcactccagcctgggtaatccttagggcttttctcaggaatgcaagggtgatttgatgttagaaagctattattgtgacttactgtgtaatgctcatctccatagagggagaaaaggcatttgataaaattcattgctttttttaattaagtaaacaccctgtatttatggggtatatgtgatatttggtacgtgcattaaagttcattgctttttctccttgggaggttgaggtgggaggattgcttgagcccaggagtgttgaggttgcagtgagctgtgattgtgccacagctttccagcttaggtgacagagtgagactctgtctcataaaaagaaaagaaaggccgagtgtggcagctcacacctgtcatcccagcactttgggagggtgaggcaggaggattgcttgagcccatgagtttgagaccagcctgggcaacatgaaaccctgtctctaaaaaaaaaaaaattttttttaattagccagatgtgatggcatgtgcctgtagtctcaactactcaggaggttgaggcaagaggattgctcgagtccagaagtttaaggctgtggtgaaccatgatcatgccattgcactctagtctgggccacagagtgagaccctgtcttaaacaaaaaaattattgcttattgataaaaggttagtaaaccaggaataaaagggaacttcctaaatctgtttaaggatatgtatcagaagctttcatcaaggatattacacatgaaactttagaagcattctccttaggccaggcatggtggctcacacctgtaatcccagcacttggggaggctgaggcgggtagatcacttgaggtcaggaattcaagaccagcctggccaacatggtgaaaccccgtctctaccaaaattataaaaaataagctgggcatggtggcgtgcgcctgtacttccggctatgtgggaggctgaggcaggagaattacttgaacccaagaggtggaggttgcagtgagccaagatcgtgccactgcactccagcctggcgacagagcgagactccgtctcaaattaaaaaaaaaaagcattctctttaaaatcatgaacgagggccaggcacaatggctcatatctgtaatcctagcattttgggaggctgagacaggtggatcaatgaaagctgggagtttgagaccagcatggccaacatggtgaaaccccgtctctactaaaaatacaaaattttaccagctgtggtggcgagcgcctgtaatcccagctacttgagaggttgagaaaggagaatcggttgaacctgggagacggaggttgcagcgagccaaaatcacgccaatgcactccagcctgggcaacacagcaagactctgtctcaaaaaaaaaaaaaaaaaaagaataagacaggaaaccatttttcaccatttaataaacgttgtacggaaaatagtagccaatattaggccgggcgcggtggctcacgcctgtaatcccaacactttggaggccgaggtgggtggattacttgaggttaggagttccagaccagcctggccaacatggtgaaatcccatctctactagaaatgaaaaaattagccaggcgtggtgatgcgcgcttgtaatcccagctactcaggaggccgaggcaagagaattgctggaacctggaggcagaggttgccgtgagctgagatcacactactgcactgcagcctagacaatagaatgagtcttcgtctccaagaaaatactagccagtattataaaggaataaataaagctgtcattgtttgcagaagtctatgtagaaaactcaagagaatgtacagaaaatcttttagaattaatagagttcaccaggatataaaattaacatacaagtgcagcatcaaagaggaaatgtaatgttaaaaaagataccattgataatagaaaccaaaatgtcaggtactgcggaatcaatattacgaaatatgcatgtaactttagagaaaaataactgatattttagcagacctcaataaagatgtatttatatataggaagattcaagcttctgaagttgtcaattctccctttaataatctataaattcagtataattctaataaaacttccaacaggaatttatttgccctttgtaagtggatgctgctgtggccacatttgaagagaggcttggcctgaggatttgctctaccagataggaagttatcttatttaaaatagcagtatttggccaggtgtggtggcttacgcctgtaatcccagcactttgggaggtcaaggcaggcggatcaccggaggtcaggagctccagactagcctggccaacatgatgaaaccttatctctactaaaaatatagaaattagttgggcatggtggcaggcgcctgtaatcccagctactcgggaggctgaggctggagaattgcttgaacctgataggcggaggttgcagtgagctgggattgtgccattgtactccagcctgggtgacagaacaagattctgtctcataaaaaataaaatagcagtattcacgcagggcagtgatatggcccaagacggggcccagaacaggctctcgagcatgtggacatggatgggaaagcgctgcaggccagttgcgtgggaggtctgcactggacgtggtgctgggaccactgtgatttatgaacttggccagcatgggagaggagctttgtcaccatgggagagggaaggatttcttaaataagccaaactaataacaggctataaaggctataaaactatgtatgttaaaatgaaaatctaggccaggcatggtgactcacgcctgtaatcccagtactttgggaggctgaagcgggaggattgcttgagccactgcaccacttcagcctgggtgacagagaccctggctcaaaaaaaaaaaaaaaaaaaaaattcttatgtgtcaaggacaccatcgacacagtgaaaggacaaattctgtaaagagccgaaacaattctgaaggagaagggcaagtttcttggagagccagtaagtgcatgaagagatgctgctcaactgcggccatgcccaggaagctgtatgttacgatcctggtgggatggtccttcacagtcatccttcacagtcatcaggtgagcagacatcaaactcagaacagccagggattgagaagatgagcaacagtgggactcctcatacaatgctggtgaaacatcatttattacacctgttttgagagaaatttggcaagatctagtgaaattgaagatgtgcctttttttctcttacagttttactcctagatatttaccctagagtaattttgcccttgcacgcagagagaccacagtgtccaaaaccaaaaagctacccagtgacagactatggtatgttcctacagtgtaactacacatcaattaaagtgaactcattggatgtcaaagcagaaacaaattgctgaagggtatgcagattctatcacttgtgtagtttgaaaagggccacatacccacaactgagtttaacttatccctttctctgcgtccatctaaaaagtgtaagtgggcagctgtgaaggtatgtgcctctctccaggagccaagaggtctatccaggcaggagccattaacacctggtggagtagctgtggtcattgttggatataaaatgatacaaagcaggccaggcgcaaggtgggaggatcacttgaatccaggagtttgagaccagcctgggcaacatagcaagatcttatctctaccaaaaataaaaataaaataaaatggtataaagtaatcagcaatgtgtgtacagccaccgtttcaggcatgttgggggagggtgcagtggcaagctctgaatggacactccagtgtttgacagctaggcctgcgcagggttggtgaggtgctgtatgctcttgggccctggaagcagggtaaggcggtgtcgggtgggaaccgccccgtcagccactctggtatgttgctcggctgtgtctctacaacctgttcactagtttggaattgtgaaaaaaatgggtacctgagaattgaagccactgtccaaagaccaccctattggctttttgggacccaaattgatctcagatggtccttctagtgctaagaaatgtgctaaaaatgaaagtctggattggcactatactaaaagtaatataaaaccaaactgaaggtatacagttaaaactgagttctgggcagagtgcagtggctcacacctgtaatcccagcaccttgggaggccgaggagggtaggatgcttgaggttggtagtttgagaacagcctgggcaacacagtgagactctcatctctacaaaaaaaaaaacaaaacaaaacaagaaaattaacggggcatgatggtgcacacttgtagtcttagttactcaggaagctgaggcaggaggaccacttgagcctggaaggtcgaggctgcagtgagccatcattgcgccactgcactccagtttggatgacagagcgagaccctgtcaaagcaaaaactacaaaaaattgagctctgtgttaatgtccaacactctgccctgcccacccctggttcctgatgtaaggcccatggggcctcccttccctcccctggactctggctgggtggttttgaagaattttctgttatcggaaaagcaatgactattaggatgctctttaactgttctgtaataagcaattctaaacttgaggaagctcctccctgcttccatctgtaacctaggtctttctacattgttttttatttttcgggagtgctggtgcacacaaggatggtttttgttggcttgtcagttaaccaatggccaacccttgagggatagagtcaggtggaacttccttgctgctttctgtgccttccttttctagggtccctagatgtaaggctgacttcaggactttttgttgctacttgctgactctttagaggtcattttctttttctttctttttttttttttttttttttttttttgagatggagttttgctttgtcacccaggctggagtgcgaaggcgccacctcggcccactgcaacctcctccccccgggttcaagcgattctcctgcctcagcctcccgagttgctgagaccacaggcacatgccaccacatccggctaatttttgtatttttagtagagatggggtttcattatgttggccaggctggtcttgaactcctgacctcaggtgatccacccgccttggcctcccaaagtcctgggattacaggcctgagccactgcacccagcctagaggtcactttctagcttcctttctccgtactagtgaagaaatgtacttctttttatatatctatatatatatttttttttgtttgtttgtttgtttgtttgtttttgtttttgtttttgagacagggtcttactctgtcgcccaggctggagtgcagtggtgcaatcatggcttgccacagccttgacctccctaggctcaagtgattctcccacctcagcctccctagtagctgggactacagccatgtgccaccacgcctggctaacttttctattttttatagggatgaggtcttgctatgttgcccaatctggactcaaactcctggccttaagcgatcctcctacctcagcctcccacagtgctgggattacagacatgagccagtgcacctggccggctccagtatgagcagcattttcactagcaggctttttgggcctgaatttttttttttttttttttttttaagacgtagtctcgcactgttgccaggctggagtgcagaggcatgatctcggctcactgcaacctccgtctcccaggttcaaacgattctcctgactcagcctcccgagtagctgggattacaggtgcccaccaccacgcccagctaatttttgtatttttagtagagccagggtttcaccatgttggccaggctggtctcaaactcctgacctcgtgatccgcctgcctcagcctcccaaagtgctgcgattacaggtgtgagccaccgtgcctggtttggcttgaatttttaattttttttatttttatttttgagacagggtctcactctgttgcccaggctggattgcagtggcacaatcacagctcactgcaacctccgccttccgggttcaagcgatcctcccccctcagccttcctagtagctgggactactggtgcacgccaccacacccagctaattgttgtatttttagtagagacagggtttcaccatattggctaggctggtctcaaacacctgacctcaggtgatctgcccacctcggcctccctaagtgctgggattataggtgtgagccattgcaccagcctgagtttttaatttttaaaggcttttctacctttcctgatcctaatttttacacatccattagattggaaccagtgctttatgtcagttctttttacatgccttggtattagttatctattgttgcataacatgttacctcaaaacttagtggctgaaaacaacaacatgcatttactgtctcacagtttctgtgggccaggaatttggcaaccgcttagcttagtggttctgccttagggtctcttgaagttgcatttaagatgttacctggggctacatcatcctaaggcttgactgatgctggaggatctgcttccagggtaccttctctcactcatgctgctggcaggaggcctcggtccttcaccatgtggccctctccacagggctgctggtgtgtcctcacaacatgatgggggctggctttctccagagtaagtgatccaagaaagagcaaggtggatatcttttatgccctacacttggagtcatatgcaaccatttctgcactatgttattgactacgccgtaagcagtagtgggggcttgagctctaggaggcagggctcacagaggggttgggggtcgtcttggagggtggatacctaaacattcttcgctgaatcctgaaagcaaaagaaaactctaaaaagatgttggggggagcacagtgcagtgcctcatgcctgtaatcccagcactttgggaggccatggcgggcagatcacttgaggtcaggagttcgagaccagcctggcccacatggtgaaacccccatctctactaaaaatacaaaaagtagccaggtgtggtggtgcatgcctataatcccagctactcaggaggctaaggtgggagaatcgcttgaacccaggaggcagaggttgcagtgagctgagatcacgtcactgcactccagcctgggccacaatgagactcttatctcagaaaaaaaaaaaaaaaaaaaaaaaaaaaaaagccgtgtagggagcaggcaggatgaaggaggggaatgtaatctgaagactctaatttgtagagtctccaattacgttggcaatgttttagtcagctgtgggattgtggaaatttggttttccatgtttttttggtatgttttaaatttttatttatttttgagacagaatcttactgtttcccaggctggaatgcagtggtgcaatcataggtcactgcagccctgagctccaaggctgcagtgatgcttccacctccacttcccaagtagctgtgactacaggcacttgccaccatacccaactaatttaaaaataatttctttttttttttttttcaaacacgatctttctctgttgcctaggctggtctcaaactcctggcctcaagtgatcttcccacttaggcctccgaaaatgttgggattataggcatgagccatgtgtccagcttgttttttgatatgttaagaataaagaagtggccactattgagtgcttatcacatgtcagataccttgccagtatgttattgtacaaaagtatatctagtactcctcagaatcaccttataaggtaaatataaattatctctgctttatagctggctaacctgagcttaaaagttgtaaggtttcagtgagatgatgcagtcaggaagtaggagaattgggacctgaccctaattgtgtgtgagcatgcgcttttgtgtttttagaactcgtaaccatcataccatacagtttcaccgtgaagctcggagacgttaatgaggagtcattgctctgttaacctcagatgatgatgacactttcctggcttccccgcagaagccgtctgtggtggctgtcttgtgaggcgtggtggctgtcttgtgaggcgaggtggctgcagggcgcttgtgactctgctttgacgaagcagtaaaggacactgttagcattcatcctaactgggggctctggagtcatggtgggtgatggggtgccaggggcagaggtgggtgggagggcagcaggcccgtgaaggaatgtgctgtgtttgaggaggtgagaggcagatgtgttgtggatccgaagccctgtgcagaaacttccactggttgaagagctgaggcccttggagcttgaagagttgggagtgagtgggctcatggagtgagtcatggcagcaatcagggtagggcctgctgggttgggaggggtgtggcaggagtaggcatatgcagggctggggacagggaccccacagggaacactggtggagtgctgggggtcagagccagacccagaactgcagaaggtgtcctcaaggtgggaggtcccaggcagttaggctgggggtgtctgcaggttgtctagagaggtggtgggtgggcattggtgggtgttggtgtccaggccagggtgaggacaagagggagtggagcacatgactcatccaggcaacaagagggcaacaagagcctcccatggtggggccatgggaggctataagaagccgtctgtggtgactgtcttgggaggaggggtttgggtttgggggcagaggttacctgtattggctgggcaggtggtaggtccaggtggtaatggtaaccaaccaacattaacctgatggttccttaccactgccaggtggagtgttactgcccccgtttcacagagtggaggcagagacagtgccttcacttgccgaagtccacagaactacccagtagaggagccagcatcagagctggttggtgccgagccagtcagcagactttccaaagggctggtgagcagtgagggctctgttctgactgctcagctctgctgttgtggcaggaagacagccatgggcagcatgggaacaaatgcatggggctgacatccagtaaaactttgtgggcactgttgtttgaatttcctgtaatttttgtgtcatgaaatattatgatgtttttcagacattgaacagaaacaggtggtgggttacacctggctggctggcattagtgtgtcagccctgtgccctgctctcgagatccgtggctctcggacttggggacacattagcaacccctgggaaacctttaactcactgaggccagacccggtgggttgggttgatcttgggtgggacctaagcaccataggatttcaaacccccaggttattaccaggtggagcgaagtccccaggatcagacttcggtgtgtctgcggatcatcctagagaccttgtgaaagtgcagattcctggtaggcaggttggggtggggcccgggagtctgcatttctagcatgctccgggtgctgatgctggcagccctggtgtggctggagggtagggaagcctcgtcttttggctgtgcaaggttgtctccgtgtgctggcctgggctgtgacagaagccagctcgcactccttggtgtgtgccttcacccctgcccagggcctgtacctgaaagacgagggtaggtgctgcccagtgaggacactgagctgagcccacctccatgttcaggggcagcgttcctgtggcactggctctacagctaatttttcaggggtgcctagaggctgggtcttaagtgagttagtggttttggaaaagtatatatatatttttatcatttatcatttccaacatttacagaagtagagttgaattgttttcactggcactattctaatttatgagttttcattgagtcacagcatcagttaagcactacttttctttgaagcttttatggacatagttccacgatgtgggaataaaaatgcgacacactaagttctaaagggccgtgcatttgatttcatgcaaaacaaaacccaatgagttttacggatttaacttctcattgcaccttctcccgttcccacaggtggtagctgagcacccagatgcttcaggtgaggagattgaagagctgctcaggtcacagtggagtctgctgagtgagaagcagagagcacgctacaacaccaagtttgccctggtggcccctgtccaggctgaagaagactctggtaaacatagcattatgctgatgtcctctgcttgggttgatgtgtgtagtgtagcaagctgagctctgatcttggaaccgtagggaagtgtgtccactctccctgtttctgacccgtggggtttgggccagcggtccaagtgcgtgtggtcacagtaaaaacagcttctgccatctgcgtttactggcttatgagagctattcaatgtagtgccttctggcctgtggctcccttgctctcctacccaagttgagcagccactgtggtcactgctgctgatggggctgtgtgaagagaggacacaagaaggaaggggagggaaggtcgtctcttggattccaggcttacatgatgtggtagggtcagccttcaggcctgtgacttccgaggaggcagcacttttcttgcttctgagagcaatcctcctggtttcggctgtagtctgcaccttacaggggtccggagtgtgggcagctcctggcttgtttgcctgagagctcatagggcaagaagggtgactggactgaccttgaattcaggtatcctttggtccttcctaggccttcggcttaaaaaaaccaaaagtgctagtttgctttgggcagtggcaagaggagggagagctgacattgtaagatttgaagatgtgtaacagtggttagatttgtgataaatatgtgcttggatgtaaattgtggaaaactgagatttgaatgtaaaaataactgacatattagggtatcaatttaaaattaaaaaaaaaagtactgtatatctgaagagtcatcattgaggagctttggagagtccaaacataaagtgtttcaagactcacctaaagggaagtcggggcccagaagcgaaagggtctggccacatgtgcctgctgtcacctttctctttctcagatgttttcatcttgatttaggtgtttctagatctcttcatcagctatctcattaatcttgaatttgttcaacttcctcagtgttcattgcaaatactataatttagaatagcaaggatatttaggacttgtatattttctttaaaagaaaatatacctcactctatcagtacactaaatttagagacgtgttccttttaaatgactggcttatttaaaaatgagccagctcttcctgaagccagattcagcttaccctcgaagtgtaagcataaatttgattgtgttatattttgctgagtgcttagtggatagaagtgacagttgagtttctgcccacagtgtgtgtcaggtgtatgcaggttcttgggtgtcctttaatcctgactttcaggtgaccctggtgctaacaactaggatggcgcaccacatcattgtcacgcgcccatgacctcagtgttagaaatctacacagatgtctgggcacggtggctcacacctgtaatcccagcactttgggaggccaaggtgggtggatcacttgaggccaggaattcaagaccagcctggccaacatggtgaaaccccatctctactaaaaatacaaaaaaattagccaggcctggtggtgcatgcctgtaatcccagctactcgggaggctgaggcacgagaatctcttgaacccgggaggcagaggttgcagtgaggcaagatcacgccactgcactccagccttggcgccagagcaagagtcaatctccaaaaaaaaaaaaaaaaaaaaattccagcccggcgcagtggctcccgcctgtaatcccagcactttgggaggccgaggtgggcagatcacctgaggtcgggagtttgagaccagcctgaccagcatggagaaaccccatctctactaaaaatacaaaattagccaggcgtggtggcacatgcctgtaatcccagctacttgggaggctgaggcaggagaatcgcttgaacctgggaggcggagattgcagtgagccgagatcgtgccattggattccagccaatggaatggccaacaggagcgaaactccatctcaaaaaaaatgaaaatccatacagatgcccctgttgcttgtttctgtaagaagcggctgctgcctcatcctggatgaatggagaggtgctcaggaggtgctgtgtcgaggatgtgctgtgtcaaggacctcgcctgtgggaaagcgaggcgcggggctggctttgtgctcacgaacgggtgttctgaaggcagacctgcctgaggggggcctcgagagtttggctggctgtgccatgtggtgcctatgcttggcagtgcctgagcaggtcctgctgccgagcattccacgggcttcttccccagactgcctttgcaccagcctgcagtggtgtggccaggagtgggcttcacgagggctgcttgcctggcccccatcacaccaggctggaactgcagctggtgagggcccccacgctttggctgctgactcttcttgcgcattgggctcaggcctagacctgaggtgaggctctgtgaatgcattggcagcagggcacggacacttacttgtacctctgcctgaggccttgctggaccctgtggagctgagcactcttttgctggtgtctcctgtcccaacagtagtgaggcttgagggtgacagcgtccttcagggcaacagtgtccttctgcaagatgttttttttctttgagttggagtcttgctctgtcgcccaggcggctggagtgcagtggcgcgatctcggctcactgcaagctccgcctggcgggttcatgccattctcctacctcagcctcccgagtagctgggactacaggcgcccgccaccatgaccagctaatttttttttttgtatttttagtagagacggggtttcactctgttagccaggatggtctcgatctcctgacctcgtgatccacccacctcggcctcccagagtgctgggattacaggtgtgagccaccgcgcccggccctgcaagatgttttatgaagagtccattaataaaaaccctgaacccctccgtaaagcagtcatgcaaatgataatattggatttatatttaaaataaacattggcatgttgaaattaatcatctctgtagaatttgcacttacaccttaccgtcttaggttgatattgtttggatgccttaggtcttggattaactgctattcctgggaacacctaacacatggaacagctgagcaaacatggaggaagcccttaatttgcatatataaatgttgtgttactacttaacatgtttaaggaaatgtttaaaaagtagcaagttgtttttttttttaagttcaacttaaattccacaagtctttgaatgttagtaaggaaaagattttttttttgtttttcgttttttttttagacagagtttcgttcttgttgcccaggctggagtgcaatggcacaatctcggctcactgcaacctccacctcctgggttcaagcgattcttctgcctcagcctcctgtgtagctgagattacagacatgtgccaccatgcctggctaattttgtatttttagtagagatggggttcctccatgttggtcaggctggtctcaaactcccgacctcaggtgatccgcccacctcagcctcccaaagtattgggattacaggcatgagccaccatgcccggcctaggaaaagatttttttaaaatactgggctatcaggaggcagaggttgcagtgagctgagattgtgccattacactccagcctgagctacaagagcgaaactccatctcaaaaataaataaatagataaaatactgggttatatttaaatttaatgctttaatacattaaattataattataaggccaggcgcggtggctcacgcctgtaatcccagcactttgggaggccgaggcaggcggatcacgaggacaggagttcgagaccagcctgaccaacatggtgaaaacccatctttactaaaaatataaaaattagctgggcgtggtggcacgtgcctgtaatcccagctactcaggaggctgaggcaggaggatggcttgaacccacgaggcggaggttgcagtgagctgagattgtgccactgccctccagcctgggtgacagagcgagactccatcttaaaaaaaaaaaaaaaaaaaaaaaaaaaaaaaatatatatatatatatatatatatatatataaaaaacagataaaacagatgctaatataatccctaaggttagatatagtcaccagtttttttgttgtaaagagatttgatctgtaagacataagccctggaaatcagcagggttacaggaaacccatcatgggctggatctgtatgttgaatgccctgggtaggttctcacagtgcttcaaatgcagcttttggagtggttttcatgtacattttccccattccccattccaaggtaatgtaaatgggaaaaaaagaaaccacacaaagaggatacaggaccctacagaagatgctgaagctgaggacacacccaggaaaagactcaggacggacaagcacagtcttcggaaggtaattgtgttccaggtttgcttgacctgtcagagtgtatgctctgtgactcttggtgccactgtttccctgcatgggagcacacatgagatgcaggtgtcagtgcacccagctccttccaggctggtattcagcagaaggcttgcatttcttacagaaccccattgagaaaggctgcttgcaggttcttaccctccaggggtgttatcacagaaaccgatggtgtgttgctctgcaagaaaacagacatccaaatgctttgagtaatacttgttttttagattggacaaaattgtcactaaaaataacctctttggccgggtgtggtggcttacgtctctaatcccagcactttgggaggccgaggcaggtggattgcttgaggtcaggagttcgagaccagcctggccaagatggtaataccccgtctctactaaaaatacaaaaaattagctgggcatggtggcgtgcacctgtaatcccagctactcaagaggctgaggcaggagaattgcttgaacctgacaggcagaggttgctgtgagctgagatcatgccactgcactccagcctgggcgacacagcaagattctgtctcaaaaaaaaacaaacaaaaaaacccccaaacaccataacctctctatagggcttattattcaggatgtaagtaatgaactggcatcaaagtccattagagatatgtgttacatgtcaataaaaagtcaacagttcattaaaggcaatgaacctagattttatttagtttattagtaattcatgttattgtttactgaatgggaatactaaacaggctgtgcaggaaaagtgcagcatagatacaaagccagccccgggtccttgtgctcctcgcttactgccagcatgtgtccagggacagagtttgcctggtacctgcaggggagtgaaaccaaccaaggaaacaccgggttattctgtctagcgtatggtgcccatgcatgtagaagacgtgagcccttttcctagtgtatgaagtggtgccattcatttcaactgtctcagatgtccggttaactttttcatgaactgagactttaattagactttgtactttgtttgaatttctattttattcgataatagttctggccgggtgtggtagctcacacctgtaatcccagcactttgggaggctgaggcaggtggatcacctgaggtcaggagatcaagaccagtctggccaacatggtgaaaccccatctctactaataatacaaaaattagtcgggtgtggtggtgcatgcctgtaatctcagctactcgggatgaggcaggagaatcacttgaacctgggaggcggaggttgcagtgagctgagattgcgccactgcactccagcctgggtgacagaaggagactccatctcaaaaaaaaaaaaaaaaaaaaaagttctgacagagtagttgtatatttgtgattttgagtaaagcttcatcctgtttttcactgatctgagttaaaatgctctttttatttcaaagaatggaaaatacatctcacatattgctaaggtgtaaatatgtggacaccatatcatttaccttatttctttaaacttgtatttgtagttgagaggagcaggcaggccctgcgccatttttctggcccacagaacattcttctggggcacctgccataggtgaggttgttgagtgatcaagtgttcagcagtaagctaggtcagattcacctgtagtcactaaggtttgtagttaccaggaagcctgcacttaacatttgctctggtcacctaattttttttttttttgagagggagtctcacttcgtcacccaggctggagtgcagtggtgcaatcttcactcactgcaacctccgcctcctcgattcaagtgattctcctgcctcagactcccgagtagctgggattacaggtgcgtgccaccatgtccagctaatttttttgtatttttagtagagatggggtttcaccatgttggccaggctggtctcaaactcctgacctcaagtgatccgcccacctccacctcccaaagtgctgggattacaggtgtgagccactgcggctggccaggttaccttctattaaagcagccctttgctggcaatcatactgaaactggttgttttgaaatatttgtgtaaatgttatacctaaaaaatacatgaccctagacactcagaataccaaaattcacattaagtggctagtaatgttttattagctcctatctcaggagatagcacatgataaaaagaagtaatggtgtcttgtctcttcagatttgggttttataaacctgagccaaaccacatatgacacccaatgtgcactgagcacttctgacatgctaggcactgtcccaagtgcattctcctgtcgccttgtccatgatcctctggattccacctcaccgcatcctgtctcactggctctggttccaggcaggtgggtgagatggagtatgagtgcaggagtggcaagtcattccctgggcagcgctgctctagtgctatggggacaggacagttttcagccacacctttcagaatctcagcccttgagaaaagcttcatgatcccttctcccatttcttgcttttctcagttgtgacatgttttactgatgatctttgttcattaggtgtatctggtgtttgtctaaaaattggaaatcctcagtatagtgatactagtaatgttggtcctgacttagcagggctgagtctaacttgattgggcacctcttgaatggaaggatccatttttctcatgttcatcctctgctttgggttcagtggagagtctaggtgcatgttcaataagactcgtatcaggtgtcttaaccacatgactgcagcgggtcttggcgtggccccacccacctcgccctcctgacagatgcgagagcgggaggtgcgaagaaagaatcagtccagattgtgaaaaaagtctgagattgggcaaccatggatgacttatgtgtggaacacatttccaaaggaagaagtttctgccacgaaacttttcagcaacctgtgttcattcacatgaggagattttttttcctttcttttccttttgttgttctttttctttttttttcctttttttcttttcttttttttttctttctttttttttttttttttttttttttaaataatagagagacacaatcactgacaaaacggccagaacaagctcttacaaggccatggaggcagcctcctcgctcaagagccaggcaggtaatgtggtcagcgccctttccttcttggcttctgggtgcccaggctgggctgggtgggtgggctgagagtgtgaaaggggaaggctggggctggtgaaggggaacagggcaggggaggaatccacaattaagctaggagtgaaaaagaaggaaaggaggttctcctgtggttgaaaactaaactgttttaatgtgtatgttattttgaagggtttggctaaattttattgaagttactttttacttggctctattatttgcaatttaaaattttactagaaaagtgatttcaaccagaagttttcaggtttcttacttgatggtgccagttgctactgtaaattctgtcacccttcagtaccctgaccctctgcatgtaagctaacagtaagggctcgttatttatatttcacatgctaaagaaactagcttaaaacctttatgaaaaataattgtcaaaaaaataagaggggaaattacacttccttttaccttttagttatctttttgaaatacctgtttgatcccttattgaagaagtcataccttctccaactcttaattaaaaggaaaacaaaaccctggggaggagagtggcaatggctctgtttttcttgttttgcatgaggtgcttgactggcttttaaaaatcagttaaacagactttaaaaaaaaaaaaagacatgagcaattggacatttgaacgctagctgatgatataagagcattgttacttttaagtgtgggagtagcattgtggttatatgtaagactttatgtttagagatttgtgctaaacttcttatggatgaaatgatatgtctgggatttgcttcagaataatctggcagggggacgtggaaccaggtatggatagagccacgctggccccaggttgatgtttttgggggccaagtagcgaggacatggggttcattgtacagtttgtctgcttttgtttatgttcagatttttccatgatagaaagttaagccagaaggacaaaggaattcagaagattcatctttagaacttcacttatttgaggggtaatttttaagcagtaaaaagatcaagggtttatgatttgaaactttacaaaccaaaattattttacagcaacgaaaaatctgtctgatgcatgtaaaccactgaagaagcgaaatcgggcttccacggcagcatcttcagctcttgggtttagcaaaagttcatctccttctgcatccttaactgagaatgaggtaaaataataataataacgataaccatggcattggtatgaaggccatttagctgcccacgctgcagtgtgagtaatgctcagacttcataagcgcagcattggtgctcactgccagtgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacataagaggcaggaagagttttgattctatccttttttactaaacagttttattatgacactagatacagtaaatttttagaaaaaaataccatttacagtattattgtgaaccatttaacccttttgatccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggaggtgggtggaaacggctcttgtttgaaagaacttagggaggaccattggcttgccaagagtacagaaattcattatgctgctaatttaacgtggaattccttcatttcataagaacctcaaaataatggtgatacattctagccttaagacatttgaattgccggttgttgaggtgaattttgtttgtcatacatggaaccattttagtcccatttgactcacttcagaccatcttccacacactatgtctgtgcttggagaggggaggtggctctccagtgtaaaacttgaggcattcactagaggtgaaaacttgtcagaatatataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcgtgatccacccgcctcaccctcccaaaatgctgggattacaggcgtaagccactgcacctggcggggtcttgcttattttaaaagaaatattctgattcatattttaggactttttgtcaacgaaattggttttgatccctttgggtaccatttttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaattatgtcagtttatagaaatatttattgttcaaggtctgtaattgtatttcaaaaacgatgtcgtattcaagttgtgaagggatttgttttgtcaaaaaattaaaaactcaatgtgtatgacgccactctgaagagtaggtgagcgctttgcagtcacagaaggtggcatctgactgcggctcatacaggtcaccctgaagggccacgtgcttttagcagttggctggaatgtgttcactaggttccgttatgtttggtaatatcatcttgaaaagtccctgtaatagatcaaggagactgcattccctgccctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctgacccaggactgctttgtgttttctgtctttctctccatgcattttttttctcatttttaaagctttttaagtttgttccaccacgttaagggaagagcatgggttggtggatagcgctggggctctctcccctgagccatgcagaaggcccctttctctgggccttggttcccccatcagatgggtcagcttgggcgactgtgtgggtgactctctgagtggggccccagacagtgtggccactgcttccccatgccctgtgctcccctggctccccctccagtctcatctcagaagtgctcaggtctccactgctgagtccatatctgatgcgcttgttaaattggaggtttgaactcagagcacgtcaagtggccctttgtgggtgttaaagaacaggatgtgcgctgtggctcttgcagggccctcctggcagcctcacagtgacagagccttaaagtgtgcactgctctgattagtgttcatgacgctagtccatcttcctggaaaaggtgaggaaaccaagattaagaggctgcgttttctttagactttgtgctgtcaggagatgtatctagtgagaagagaagagtggctcacatctgtcaccacccacagtcaccagtcagaggcgacggaagcccttggaaaaagcccactctggctgggtgcggtggctcatgcctgtaatcccagcactttgggaggccaaggcgggtggatcacgaggtcaggagttcaagaccagcctggccaacatggtgaaaccccatctctactaaaaatacaaaaaatttagccggacttgttggcaggtgcctgtaatacccagctactcaggagactgaggcaggagaatcacttgaacccaggaggcggagtttgcagtgagctgagattgtaccactgcactccagcctgggcgacagagcaagactctgtctcgagaaaaaaaaaaaaaaagcccactctaacactactctgaagtcagcaaacacttctgtgttagtttttaatttgtttttcttccaccgctccctgcaatgtcagctaaatgtggaaaagctcactgataaggtcacaggattggtcaagagtccctggtggggttggcttttattttttaatatggcccaattccaatttctgacttcgtgttcattggcaaacagcaagccgataacataattacttgtttttgtgatgattgaggtgtacaggaaatgtagtttatgcttttgctctgtttcatctccaaaattcagtgttcaacacttatttacctaacatcaaataaaaaccaaattttttaaacacttgatttgacagacaagaagattctctattttattcatttaaatatttgttgatgttgcttgtcaggtgagggtgaaatgctgtgtatgtgagggtgaggctgaggctgtattcagcctggtcttcagtgatttctattaaatgaaggggagagagaggcagaagagatacaacctgcgagcaattccactcgctcagggattccatgcctttatcccaggccttttacctagactcagatgtgaatcaagtaggtagattttaccttgcctttgcccacctcacttctctggtggggagaacaagtgaactgtgaaatatcaggacaaataggcaatgggaggaagaagagaaaccgaacggtcagcctgtggtgtgagtccggaagactctcctgactctgcacccccgcgtaggcacatacttctgaaaggacgcatggtctccaccccggcggcagctggactgcacggtcacctgatgaggctgacacttacttcatctgtggttcctttacacattcgtttggtgttagcatgtttctcccaccttagagtagtagaacctgaacagactaggtaagaagggccaagattcttgttccaaaaagcctgtcttagttcacctactagagcaaattggatgttcataacacttccttcattttaaggaatatgcctcttatatgcatatatatgctaaatactaggtagaataaagtccgtttttgaattttctacatagcctaattgacgggttatattatcacaaaaaccagttgatgatggttccactgtgaaatcactggcggtacaggaccagtgctgagaaagactggtgggtggtggggtggggcgggacgagcctgcctgcagggcatggccacccgctgtgttctgcgactagtgaactgtcatccgcctccttcatctctaggtctcggacagcccgggagacgagccctcggagtccccatacgaaagtgcagacgaaacacaaactgaagtatctgtctcatccaaaaagtctgagcgaggagtgactgccaaaaaggagtatgtgtgccaggtgaggagaaggcagcatccgctatgtccgtgctggtgtctgactggggccccggtacgcagagcgaatttgtagtgtcttttcccttcccaccagaccccttccccaatctcaccgtcactcactcatctctgttttgaaggggtcagactgactctcagtggaatcctgggattgagttgtctccattaacatccataattcacatgtaggatgagatttgtatacacatcatgtaatacacacacacacacacacacacacacacacacacacacacacacacacacacacacacacacacacacacacacacacacaaagttcctgttggaaaaggtgaggtgctaggcctgttttagcttcactgatgacatgcacactggacaggccaggctgtgggctgagggggccatcactagacctgtgtgtgcccacaggaccccagccaggccacctacactctgtgcttcagtcccgccccatctgtcagctggagatggcatgggagcttccatgccaggcagtcgatgcatgggaagtgtgaatactgcctgccgtcagcgtggcacctgccatctggattagggtgcctttgatttctgttgattttcaaatctgatttgaaatatcttggatgtatccttcagggttgtgatcctgttacttcctttgccattgctgaggactggcctctttctgtaacagtcatctggttttaatctgattctgtatttgtacgttctgtttgggccagacgtttgcccatgcatgttattatatatccttgagtagcaaaatgggattttctgccactggagacagaagcagacggcttcccttgtggtaagaggtgcagaagggactgccgggcgctgcttacccgcctgctctgcccccgcagctgtgtgagaagccgggcagcctcctgctctgtgaaggaccctgctgcggagctttccacctcgcctgccttgggctttcccggaggccagaagggaggttcacctgcagcgagtgtgcctcaggcaagttcccacgggcgggcagctctgcagcctggccggccacctgctcctgcaaccccctgcaccaagtcctgccctgagctgcctgcagaggacaagccccctccccacccccaccgcctggccctctctggagcttgtagcccacagctggcaggtgtacccacctctcagtagctgcagggtttgctctgatttcagtcgtatgtgcccccttggtacctttccatcaggtggcgggcagggtggcgggatgacaggtcatgggcttttcatcccgtgggctggcctgagcctgtgctatgtgtgaggcggccaccacagggcactgccgctcagacagtgcagcattaagggtacaggtaacctggttggtcaccgaacactgaagtccataggaacatggagttctttatgaagacacagtgtcaccttgagcctcagtttcaacagaaagaacagctccaggcttgtcctgggttgtcagtgctgttgttctgcctccatgttactgcatcaggtgtcgcccggcacagtctggggtctgtgaggatgatgagaggacacctgcacagccgtggcccttcctgcctactcaccgggcccaaggagtctcctatctcacgtcagaacacttcctgggtcaggaagacacctggagagtctcccaggccatggcagccccacagcagcacctcacttatgggagtgtctgtctgcctgcccagaatgataagtgactgctccaccactggccagctgctctcaaggaggaaaggcctcttttcataggagccccttctttcaagcttcttgccagttagactgggcctccccagccaggctgcctagtaagattctcctgtatttcaggtgaagctggagctcagatcgcagcaaggtaatccttgatggctggatctttttgctggagaatgcttggactagtgagcaaggttggaaacagggccaggtgctttagcagcatggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtacaggtgcacctgcgcagccttgctgtgggttcagatgcaggccagacgcaggcccatgggcgcttgggaaggtgggctgttgggattgtcaccaaagagcattaattatcttgagtgactaactggacatcggctgggttgggttttctttgacaaaggacctgtctcccttttccttctttccatcctaaatatcaccctaaagatgcttaactataggagaggggcaacctttggaccatttgatagattttgtttaccctggcttttttttttttctttatagagatagagtcttgctctgttacccaggctggagtgcagtgcagtcacagctcactgcatccttgacctcctgggctcaagctgtcctctcgggctcaagctgtcctcctgcctcagcctcctgagtagctggaactacaggcacatgccaccacacctggctgatttttgtaaatttttttttttttggagaaaaaaaatctccctctgttgcccaggctggagtgcagtggcacgatctcagctcactgcaacctctgcctcccaggttcaagcgatcctcctgcctcatcccttcagtagctgggattacaggcacgtgccaccatacctacctaatttttgtatttttagtagagacggggtttcatcatgttggtcaggctggtcttgaactcctgacctcaggtgatccacccgcctcagcctcccaaagtgctgggattacaggtatgagccaccacgccttgccaatttttgtatttttttgtagagatgaggtttcaccatgttgcccaggctggtcttgaactattaggccactgctctgacctcttttcttttttttgagacagggtctccttccgttgctcaagctagaatgcagtggtgtgatcatggctcactgtagccttgacctcccaggctcaggtgatcctcccacctaagcctctcaagtagctgtgaccacgacgcctggctaattttgtttatttttttgtagagacgaggtctcactgttgtgttgcccaagctggtcttcaactcttgggttcaaagaatcctcccacctgagcctcccaaagtgttgggattacaggcatgagccaccacacccagcctgtttgctctggttttaatggcccattatatgtaagaaaacatctttaaatcaaattacatttggattttctaatgttaggtgtgtgggatgagggtggcaggttttctgtacttcttgacaccagtggttctttatcgggcaattttgtcctccaggggacatttggcaatgtctggggatattttggggatgtgctcctggcatctagtgagtagaggccagggatgctgctccacactgcacaatgcccaggtcggctgcccacgtgccccaggtgcctgcagtgcccaggctgagacacgcggcattttagatgtatgaccattttctcaaacatggttttgaagcacctttgctctgaaagctttttttaaatcaaatacctccatttcattttagcattaacttttcaaattcatggaggctgagtaattattagttgctcttttcactatgactggagtcagtgtttggggtccttagggtgtgtttctttgccttcaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggtgaggggcctgggggtgtctgcggcacacgcctctcacactcccaggagccacatatcaaggcaggctcattccttgtctgcgctgtgttcattgatgttgacagtgttctgtgcgtcttcacgttaatagtatatcacagtagctctaaattaattgtaatcatttcgcaaacatacaggaaattatttgtggtgaaaatgacatttgctctcgtgctgatgtacagatcgctgttttaaaactgatgtttataagttaaggctgtaataagtgtagactgtgaagcactgaatctgggctgagccatagcagacaggctaagcctggccgcctcgccctcctcttgcaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacaggtgtgagacatagaatcgtatgcttttatgtcttttctgttcacatgtgttcgctttacagtacttaaagtattgaaattattatcgctgtctctgaggagtctgtgaatcctgtttttaatatttataatagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacggtacggagatattcagatagagagtgagacagcactctcgtgcattttcttacccctaatttctattttttaaaatttgatctttatagaaaatactggactaagcattcaatctgtttttttaaattaggaaaatgtttgcagtctggtttatttgttgagcatagaataagatacactgataacttttgtaacattggtttgtgattaatttcattaaaattctgtaaacctattattcagaaattatttttaatactaatttacagaaatgttccatggcttgcctttatgtaaaatgcagatctgaaggaagggtcctgttgtctcgaccttgtgcagcaggctcttgggggctcgctttacctttcagtgcatgaggaatcaggggtggtcaagcagacaaggtgcttggcctctgattccccagctggggtgggaggcaggagcaacgatgtggcatggctggctgatgacccacgtttgagggaggcaggatggggatgtgacccttcactggaggaactggaggaactggtatttatgatcggtcaagagagaatgaggccagtagagaaaacccgaggtgtgtgcatgtggctcgttcagggagaagcacacgctgtgttgcagccgggtcagtgctggctcctgtgtgactgcaggcggggacccgcgtatttaaagcttggttagctccatgctgccagaagctttgcaggctgcactgagtggtaggagtgcatggtgggcattcagagatctcataaagaatgggtaggcattgaaagattttaaaaaattattaagagggcgagacgaaattgagaggtggacttatgtgtttgctgcgactgtcggcaaagtctcctaactgtggatgcaggtgtcctgtagagccagaaacctttgtggctgacttggggctgcaaaaacagggcagaccacaggacacgtctagggttgacatggggctggcctccttcttgggacggattgtaggggtgtgtgtttcctcggttcttgcttgagcctatggttaatctctcagaaccccttttgtttcgagaggagctcagctgcatgtttttttgtttttgtttttttttttttgagactgagtcttgctctgttgcccaggctggagtgcaatggtgtgatctcggctcactgcaacctccacctcctgggttcaagcaattctcctgcctcagtctcccaagtagctgggaccatacgcacctgccatcatgcctggctaatttttttttttttttttgtagagaatggggtttcagcatgttggccaggctggtcttgaactcctgacctcaggtgatccgcctgcctcggcctcccaaagtgcttcgattacaggcgtgagccactgcacccggcctcaggtgcatttttattttctgtctgagaacagcaagtcccaggctttgaccctggtgctttgtccttaggccatagtggaggacagggagctcccgacagaactctgccctgggcctgtcttgtagagaggtgatggctgttctctgagcactcctttgcctcacacacttggccgcatttaaaaatacctgcccactgacagttgttcatagactctagttttatgggaaccagaaactatacttaacattgaaagtttagagtgaactataaaaatatggagcttgaaaggtagttacctgtatttactaaaatctttactcctatttcattgactttttagcactgcaagaagctgaagctcgttttcgtgaaattaagcttcagagggaagcccgagaaacacaggagagcgagcgcaagcccccaccatacaagcacatcaaggtggcgtgtgggagctgcgtgcacgcgtgtggagggagtcttccccgagggccgtgagaggttcttaggcacacccaggctatggctggggagaggactgtcaccagccaggatctgtggtgcctggcatggatggccacacaagagaccatgagcaaatggcatggggggatctgcatgggggttcttggatccgccttggagtgtgaggcttggcttggtagcttagagaagggttggggtgacagtcctgaccgggctgcttggagcaggaggagctgagggatgagcctcccacctgcaccaggctgttgccaagtgctgggagtcagtcacatacggccagggctcagtgactgagccccaaacacgtagatcctgtacctcagagagcaagatggcggggcggcaggggagcttgccagttctgtgtttattccagtgagctcgagagccccagcaggaggaagtgcagccagggcagggctctgtgagagctccaggcccctcagggctgcctgcgctcagagctggtgcggcaagccgcatccccaggagcctcgtggccgttcctgacgagtgtttgtgataagtgtgtgccggaggtcaggtgctctgcctttgcttgtaaaatgtgggctgcagtcaatatctttgtatgtaaagaaagtgctctgtattcatctttatataatattttctttgggatggattcccagaaacagaatcacagggtcagagagtatgaaatgtttagattcttggggaatattcccagattgttctccaaaatgtacagtttgtcataccacagcagtgaaaagagtgtctttcgccacctcttccctaagattatgcatttctaccccagctgattttcagctgtctctactgctttgttatttggttgcttgtctttcactaatagtaaaccacaaggtcatgagagcagaggctatgccctcctgcctagcactgctcctcctggggtggactcccatgtggcttgctgctggtgcttggtaaaggaagagtcagagagatgggtcgggaagctgctcagaagagctcttaccagcgtttgctggacaccctgcagtgtactaagcaatcaacacgctttttctctcttcatcttacaatggcctggctggatacgtgtcagctcttgttcatcagcgatgtgcacagacactaagataaaataatgtgagggggcgttgtgttgccctgcctgcctcttgtgctaagaaggcagaggagagctcctctgggatctggggagggctgttctgagtagtgtgtcctagccaggactctgaagctttctaaaaggccacctggaggctgggtaaggagaggcagtggtgggtgtgcaagggtattcggaaggctctcatgtgtggaccaagacagcttactccttccctgcaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaaggtatgtgtcgttatcccctcccctgcttttgagaaattacggttcactgggtaattaggcctaggtttgcttgtggtggttttgtagtcatgtgagaatggtattttttggaaaaaaaattttttttgtttttgttttgagacagggtctcactctgtcatctaggctggagggcagtggcatgattgtagttcactgcagcctcagaatcctgggctcaagccatcctcccaccttagcttcccaagcagctgggactacaggcgtgtttgaccatgccctaataattttatttttttttggagatggggtcttgctgtgttgcccaggctcatttcgaactcctggccccaaaccatcctcctgcctaggcctcccaaagcaatgggattttaggcaagagcctctgtgcctgacctgaaatatttttttgaattgaattattacaattgaatattttaaaatgttacatgaaaggtatctgctataactcacacattcccttaaaacatgccttatgtcagaattctgatggttatttttatgaaatggaagatctgtgaagtgacccactttcctctgggctagtagccaggtgcttgggagcactcaccagcaggcgtaaggagattgctcttgtgaggggtggtcctggcacagtctaggaccaagtcgttggtagacaccaggacagttgacctcctgcctctgctcccagactgtgtcccaaggacatccagggactgagagacatgtagaactgctgaccctgatgtattttggcatgacccaggtccataccagggctgacccagcacagagagttcataagcctggtgccagttccagcaacagcacaaaaggttgcttagaaacacctccccagcacccttgttcctcgcctgcctgactgctgattcacccagactcttgctttacatcctgtcagatactttgtagccattttctctgttgtggggatcaccgtgtaaagtgggttatgtagaagcttggttatcagacagcgctcctgagacaaggtcgtgtaggaagcaagggttggcatattgccacttcgtgaatacttaatacatttttcattggcaacctttacatacagatatgtctgagatcctttgaatttaatttatggagactttgtacacgccctccacggaggtatgctgatgtgtgtggtgcccgttctaagtgatcatgatggggagtcttgagccccgacactgaggattggtcagcacgctttttgtcatggccacatgcttgtgatttccagggagaatttgttaacgagtacgttggggagctgatcgacgaggaggagtgcatggcgagaatcaagcacgcacacgagaacgacatcacccacttctacatgctcactatagacaaggtaatgcggaactccactgtgagcttctgcagtgtgctggacctggagccctgatggtcacctgtagaactggactttgccctgtggcagcgccagcatttgtctccttagctgcttattttcaaacatctgcacattttcttctgaggtgcagcgtgtctttcagctgcgccggagggctagagctaaccacctctcagcacccaggcaccctgaggctctgcttgtccgggtgtgcatgcagagcgttcccagcagccttagtacagggcagggaagtagagaggacacagatgaggaagtctcagcatcttcttttgtttttaaaaagtgattgtattttattttttaattttcagtgctctttgggtaaggtctcagcatcttctctgttgtgtagcagaatcgtttttgcttggttgttgcttgtatgcagcccatatttctaaccattttggaacctaggtgctagagggatcaatgttctgaggaaaaggaggataggaagatttgtgtaaaagtgggcatggataaaagacagtacatctggagtgctcagctctgggcctgatgcccaatcctgacaggtgttgccgggcccttccagggcggctccttcaatggccacagccctgtgggggtgcgtgtcatcccttccctcacacggcaggcttttggcttctggatgacttcagctggggaagtgtggcctccttagtgcctgagtggtctttgaaaggaagggagatagaatacatgtttctgccttttgttgcccttaagctcatcatctagcaggaaagtctggctatttttaaaagagtagattaatagtagtgcttgaaaaccagatagaaaatgatcaccgataaaaaaatgttgaacaattcatggaagacagatgtgatgagacctagagagaaagggctgctatggaaataagaatggttccaggaaccttgtcaggtggcccctggggaagctatatcccctacccctgcagtagtggggcagcagtggccagtggagcctgctccgggggagcactgggctctgtgtcaatcacaggtcgtggggcttacacctttcaaagaagtcagtgtcatgaaggacaaaaagaatcctgggttaaaagagactaaagaagtacccagaggaggtgtgtgcttcttgatcagagcctgaatctgggatgaggagctataaagtatgcttttgggggcagtgggaaaaattttaatttggacaggaggctgttcttcatgctaaatttcataggtatggaaagtgttgtggctgcgcaagagaatgacttgtgatgtgtttagggtcagatgtcagatattcgtaacttactttcaaaggatcgggaaaaaatttgtgtgtgtatacatatatccataaatagaaaaagcaaatgtggtaaaacgttaatactgaatgagtgaagggtatactgatgttcgttatagtattcttccatttttttcttaggtttgaaatttttttactcctaggttttgttgttatttttcttttttgagacagggtctctatcacccagggtggagtgcagtagcacagtcatagttcactgcagcctcgatctcctgggcctaagcaatcctctcaccttggcctcctgagtatctgggactacaggaacatgccaccacacctggctgatgaaatttttttaaataaaagaattgtcttgaaatagccctagagctagagaggtgggtagcgcttcctcctacatgctctgtcagggcgcaccacccaggggataagctagcagcacattcctctcagggccctgtcaacacaggtcttctctaggaggtgggctctggcataccctatgacattggaacagggattctgaagtgcaaaatgaacagaaaaccaagaatacacaacgagagagaaagaacaagccccagtgactcttcagcaacaccctcataggatgacagataaggggcctgagcttgctaagtaaataggaaagctttgcagggctggagcaaaaaggcaagatgggaagcaggtccataagggcgagagtgggtttgtacacagcgcctctaggaccatggcgtgtagagcaggcaggagcttgtgttttaaccctcatgtggggaccagtgataagtcttgctcaaaggcttggtggccaactggagttgagtaccctgtgtagacccctgggagggttttagccctagggaagggactaataaacttgccccaagaggcagcaaatatgcttctctgttgtatctggggaggagggcagggaggttatttgttagacatcgaagccctaggtctgtgccttatgttttggagtctaaatgtaaactacttatgtgctgtaagaaatgccaagtggatactgcagtttgcttttgattagtaaaaaagaaatgccaggttgagcatttaatccacaagttggttcctgacatggtaatccacctgaggtacctgattgaggcaaagataaagcctgtgacacatgagagacatttaagcaattcatacctcatatatttcctatgaaaacaaaaaacaagctgggcacagtggcccacgcctgtaatcccagcactttggaaggccgagttgggagggtcacttgaagccaggagtttgagaccagcctgggtaacacagaccctcatctctacaaaaaagaaaaaaaattagccgtgcctgtgattccagctactcaggaggctgaggcaggaggactgcttgagcccaggagtttaagactgctgtgaactatgatcatgtcaatatattccagcctgggggacggaatgggaacccggtctctaaacaaaacaaaaatttgaaaaggagccctacttaaacgtttacaaagcgcaatagaaggtgaccctcgtgagcagaccttcctaatggaaggctttgcttttagcgaggacctgaggtaacaagactacatttaaaggagaatgtgaactaagtgtattagaaatggttaaagccatgaatagagctttagacgccacaagaaaagaatgagatatggagggtaaatcagacaaatacgaacaaacagcagcggaggttaaaatagagtcattgagaggatcctgggataatggcagagcaggaagctgtgtccccacctagaccacagttgcaccagaaggacctgtctgatgtaaccattttggaactctggaagctactgaaggcttgcaacttccaggggaggcttggatggcaaattggggttaattttggtttcagctcttggcacagcagcggctacccatgccccacagacagccatgcacatgttcttggagcacctcgcacacagcttgaggggttcagggtgagcaagaaggatccttttctccaaatagtgggtatctgtgctcaggatccctgattgctgcttctgatcacagaggtgcagacaaagaggtgcgctgcgctgccgttgttatcacacctccctcagtcgttacaagcccctccccctccagctgaagtatcttcaagagtatttaaagggccagcaccaattgcccccctctttcatttttctctttttccccttttgggagccagacattaaaagactaggaaattcaaaaacaactatggggaaaataagaaaatttagaaaattagacagtgactgcatgctcagggaaaggtacagctcaaaaaagatctggaaagaccttaaatttccatcttgggttgatcctctgcacagaaacagcctgcaacaatcaaaacaagaacaataaataaaaataacaaaaacagcaaacctagggcaaggggaggaagaatctaatttctagagttaccacattattagacttaacatgtccagtgttcagcaaaaaaaaaaaaaaaaaaaaaaaagcctacaaagagacaggaaaatatggccatttaaagggaaaacaaaatcagcagaaactatccctaaaagaaaggccagatgatagatctactagacagagactctaaaacatctgccttaaagatgctgagaaaactaaaggaaaacctgcagaaagtcaagaaaatcatgcatgaacaaaatggcagtatcaatgaagagatagaaaacctataaagagaaacaaacaaaaaaaggaattgttgagcctgagaaacagaaaagaagattgaagaaaagtgaacggatcataaggggtatgtgggctaccaccaagcagaccaatatatctattgtgggagtcccagatggtgaagagagaaagaggcagagacaactttgaaaaaataatggctgaaaaattcccaggtttgatgaaacacacaaatataaacatctaaagaagctcaataaactccagatgatcaaactttcgaaaaccagaaaaagaatcttgaaaaccgcaagaggaaagctactcattacatgcaaggtgtattagtctatttttacactgctctagagatactacccaagactgggtaatttataaaggaaagaggtttaattgatgactcacagttccacataacaggggaggcctcaagaaacttaccatcacggtgaaggtgaagggtacctttgcacatggcggcaggagagagaagtgtgtgagagcccaggaaaaactaccatttataaaaccatcagatcttgagagaactcactcactgtcatgagatggcatggaggaaaccctcccataatccagtcacttcccaccaggttcctcccttaacacctgaggattacaattcaagatgcgatttgggtggggacacaaagctaaatcatatcacaagggattctcaatgagattatcagcaaatttctcatcaggaattttgaaggcctacaggcagtgggccaatgctaaaagaagaaaaaaaaatgttaaccaagacttgtatgcagtaaaactgtctttcaaagataagggtgaaattaagacattcccagataaacaaaagctgaagaagttttttagcactagacctgccttgcaagtaatggtcaagagaggtaatggagagaagtcttgtaggttgaaatgaaaggataccatacagtcactacaagttgtatgaagaagaaagatctcaaagtaaatacatggtcagctataaaagtttgtattgttgtaaccgtggtttataactccatttgtttgtttgttgtctgcatgattgaagagatagggctgggcatggtggctcacgcctgtaattccagcgctttgggaggctgagatgggtggatcaccaggtcaggagatcgagatcatcctggttaacacggtgaaaccccatctctactaaaaatacaaaaaaattagccgggcgtggtggcaggcgcctgtaatcccagctactagggaggctgaggcaggagaatggcgtgaacccgggaggcggaacttgcagtgagccaagatcgtgccagtgcactccagcctgggtgacagagcaagactctgtctcaaaaaaaaaaaaaaaaagagacatacatttaaaaaacaattactagtttaaaagctggtattgtaatttagtttgtaaattctaacattttgttttctatataatttaagctactcatgtattactagttttactcatgaattactggcttgtgttttagggcactcaatacataaagatgtgattttgtgatatgagcaactgaaaaggatggggacagagctgtaaaggggcagggtttttatgttattgaagttaaacttaatataatcaagttataacattatatagagaattggaaaactggagaaaatcaatgaaaccaaaagtttgttttttaaaaagatcaataaaattgacaaacctttaactagatggactaggaaaaaaagagaaaagactcacataactaaaatcagaactgggtgtgtgaagacattattactgcttctacagaaataaaaaaggattataagacagtactgtgaacaactgtactccagtaaattggataactgagatgaaatagacaaattcctagaaacacaaactaccaagactaaatcatgaaaaaaatggaaaatctgaatagacttataactagtagagagattgactcagtaattaaaaatctcctgagaggccgggcacggtggctcatgcctgtaatcccagcactttgggaggccgaggccggcagatcacaaggtcaggagttcgagaccagcctggccaatatggtgaaaccctgtctctactaaaaatacaaaaattagctgggcgtggtggcgggcgcccataatcccagctactcagtaggctgaggcaggagaatcgcttgaacctgggaggcagaggtttcagtgagccgagatcatgctgttgcactccagcccaggcaacagagcgagactttgtctcaaaaaaaaaaaaaaagatatttccaacttaacagtgggtttactgggacatagccccattgtaagagtgttgccagacactgaggtttcagcctaggtctgctttctcgctgcagggaaagcccatctctgacacagtcagtgttgccagagaagaaaggctttcatgtgggtgacatcagacgagaccagcctcaaatccatcttcccagccaactcaagtggttatacaggagttggtcaacaggcagcaggtggttggatgaggggtctggcatctcattgtaaccatgtgtgggaaaacaggaattagggagggataaggaaagggagttggtcaacaggcagcacgtggtcagtctggtgtcttattgtcaagatgggttatctgggaaatttcagttctttgatactatctgggagagaaattgggccaggttcaagtggagcatctgtacttgcaaaccaaattggcagcatattaaaagaattacacaccagggaaaataaccctagaccttgcattctagtgctctgcttatctgtgacttcagacaaagatggagagagctgaccatcagtataatttagctgaatgaaataatgagatattttaggaagaagaacattgaatgtcagaagttaaatgtgagatccaagaagtaacagtgaacagacaagtttgtgggtatgtggatatgtcttaaataagtcaggttgtgtcaaattatgatggatgatgatgactgcgaggcaggaaggaagatgaaaaggaggaggcattgaacactaatggtcacagggagcaccgggagcgtggtgacgccagggtgagctgcttgttctgtgagggtggagggaagagatttattaaccttagactttgttaaagtatacatgtgacgtctacatgggaaactgctaaatgaatagaagtggaaggtgtaacttccacaccattaaagggtaaaaaggagaatgaagaaaagtcaatttagtagaacctgcgggaggaagatgggggaaggagaaataatagtaattagaaagcacagattaaaaaaaaatcaaaatgtcaataatcacaatatatgtaagtggtttaaatgtataagttaagactaagattcacattagggtcagtacatagtaacaacaaggaaaggctcccacaggccttaatgtttgtagttattggggtggaggagacacaggagacagcatggagaggaagaactagattagatgcacgtccgacagttggaaagatcctaaaggtagtgttcaaagaaaaaactaagagaatgtgattcacagccaaacaaatctatacataggattctggtagcagatggcagctgctcacttccagaacaaaaaatgtacacaaagtacatcttcactgaaactgtgggacaaacagacccatccactgaaagtccaacaggcagaggaaagtactggagacctgcagtgtcacccggacacagggggtgcagagacacgggagtgcggcctggcaggcagagccagcacctggggcctgcccccagcggcgctgagagttgaaagggagcagtgggaaaagaaggcatggggagctcctgggaagaagagatgacacatctttgaaaggatcaccttccaaaaggaaggcaacatgctggaaggcagagagaaagggacctgaggctctgagggcccacagagacttgggttctgtggtgaggagacctccatcaagccgacagcagtgagacaaacctgggacccagccagtacccgctccaagaaatccgacttcttcagaaaacaatgaaaaggttatgtaagaaaaccccagccaggtgcaatggcgtgtgcctataatcccagcactttgggaggccgaggcaggagaaccgcttgagcccagcctggagtttgagaccagcctgggcaacacagcaaggccttgtctctactaaaaaaaaaaaaaaaaatagctgggcacagtggcatgtgcctgttgtcccagctactcaggaggctgaggtgggagtatcgcttgagcccaggaggccaaggcgcgcagtaagccaaggtcctgtacaattgtgctccagcctgggcaacagattctgtctctaaaacaaacaaaaacaaaatcctgacccaaaacagcagaacttccttacagatggagaaaagccacttagaaaaatttttatcacaaagtagataaaagttatactctaatattcacagattttttgaatatgaggattcagagatagccaggcagaaaggagagctaggattgggaacttgtagaactcaggagtgaaacaaggaaaagaaaattattttctaagcaaagcctaaacctcaaggaacacactagagagtaggaaccacaagaacggcacgaaggtggatgtggggagtgagcagagtgcagctgaaagaacctgggaaagagagaaagaaggaatgtaggaaagaaagagaaggatgcgagtgacgccttgggcaggggctgctgaggagaggcactgtgcattcaagcaggccagaggatggttcagcggggctgagtcacattgggcgacgtcgtaagtaggattactggacgcaaccaagaatcctgtagatacccaggcaaaaaaacaaaacaaaaagcctaaattgcttctaaggggagaaatagggccaagtggaggctgttcacagcaggacccagtgctcgggacagggtgggctcctcagaacgagccaggggtgtctatccaggcatgtggctctctgggtgtaacagctacagagatgcaggttggagcatagagaattaaaggaacatgtccttcctgagtcagctgctgagagatgagctccaggcctccagcagaatcaggtgaagctccagcaacaagttgggcagtggcagctgccgggggtgagtgtgccagaaggagtgatgcgtactcagaatgttgcccccaccagaaggggcagtgggaggagcagggagaaaggagggtaagttcacccccaacaccggcgagccagagccgctgagtcaggtgggagcagaagctgaggtgtgttcaggagcaaaggagagcatgaagataatgctactgatgagagctgggctctaggggcggttgagggagggggtccaggctgatttcagtgtgcacaagcagggacatgtaatgtccgggacattacatgtgggcatgcaggctgacgggtcacataaagggccgccaacaggacaggacggagtccccaacagcaggaaatcaagcagctcctctgcctcacagtgaaaggctgaaagcccatagaaacaagcaagacatgaatgtgttctgactgtggccagcatatctggaaagaggaaaatgggctcgcttactttttaaaggacttccagattggatcataaaaccgaattctctgcagcatgcaaggaacaaagagattctggaaggttaaaaataaaattgtgggcaggccgggtgcagtggctcatgccagtaatcccagcactttgggaggctgaggcgggtggattgcttgagctctggagttcgagaccagcctgggcaacatagggagaccctgtctcaattaaaaaaaaattgtggccaaaggtatgccaaggtgaagtcgaagaaaggagttgttctcagacaaggcagaattcaggccctaccactttcagtgacacagaagaaggcttttttgacaccagagccaccactggggatgagatgcaccctaaatttagggccttcccactggcctatgggatccaggagaaaggccagtgaatacagctgacggtgagttcacctcttaattgaaggcagagatcctggacagatgatgagcatgaattcagcactgtcgaaaagaaggacagaatacactggaggaagtgtttagagaccaagcagagacttagagaacagaaacaatagaaataaataaatctcttcttacgagcccacaatagtgccgtgtacttttcagaggcacatgtactgaggcgtgaggtccgagccagggcgtggacctgtatgtgaacatgggaggaggggacctgggacctgtgagggtgtgtgccagccggtggggtgcacctgaaaagcatggagagcagttccttgtgaccgagtggggtttaccccaggactgcaaggagggcttaacaaccctatcaggtaaaggaggaaaacaaatccagagtcattttcatgaacaccagaaaatcatttgagaaaattcaaacctattcctgatgaaaacttcccaagaaaccaggactacaagtatgcttagcttgctaaaagacatcagcggctgccagctgatgctcagtgagccagacacttgtggccggttcagaaataaggcaggacgctcacgccgctcctgtacccccaaggctgcgggtgctgggtgatgcaggcagggcagaaacagcagagcagcaagaggcaaacagtgtctctcggagaatgtgacggctgtgtttggtgatggccttatgtgaactgtagtgacaacagtgagaggccaggtccacaggttttcccctgccctcctcatgtatgcagagccacaaagagcattgatgcgtgtattgaatggagcaggcttctgtggaaagttcggcagtgtcactgacggacacaagagatgatatggatgagtggcggtacaggctatgtctcagctgggaaaggagaggctgtgagggtggaaatcttccccagtgcaagctcgttgtaggtgcgataaaaatagcaaaaacgtttaaatatacctggacaggcaatttcaaagtccatgtagaaggaaagatctgcaggtctagccagtgctttatcttgaagccttactgtgggaagggtgggcgtgtcctgggggtgacagtgttccccatggcattcctgtgactccagcggggcccaaacccaggcggatggccagggggagtggggccaaagccagggccgggcagcccacgtaccacgcactgatgcctcccctcacaccacttataaaggccaattccagatggattgaacagctaggagtgggggagatgcattttataatctgtgtggtgggaaaagctgcatgcaactactcagcaaaccgaaaacgcatgaagcaaaagggtaaaatagttgcataaggcggaggcagctttgtgagaaaagacattgtgcacggaagattccattgggagctgggaagctatgggaaagtttttgacacatttttttttctttttggagacggagtctcactctgtcgcctaggctggagttcagtggcacaatctcagctcactgcaccctctgcctcacaggttcaagccattctcctgcctcagcctcccgagtaactgggattaccggtgcccaccaccatagctggataattttttgtatttttattagagacagtttcaccatgttggccaggctggtttcgaactcctggcctcaagtgatccttggcctcccaaagtactgggattataggtgtgagccaccgcgcccggccgacatattgttataaaggggtctgatgtttggaatatctagggaacatctgtaagtcagttaagataaataaaacagggtcaagacatggcgggcaacccacagatgaaaactggcccgataagaaggaagtggcactgggccccgctggtaatggtaggaatgtaggttagacacggtgctgccaggcgtcagaggctgggttgtcctgttggcattggtggcatgtcccatgtgcatgccccgtgctgtcctcgtccccagggccctgcagaagtggtgtgcatgccaacgtgcacatcagcaccgcggctcagcgcgtcatgacaaagcatctgcagagggcagatgagcacccccacttctgtgttgaagagtggcactctgggttgattagtgcattttattattgtgaaaagcatcttgcagagaaccacattctggtaccatttctggttttaaagggtggcctgtgtgggtatgtagaaaggacacggggccagcggtcccagacaggggcaccctgggagattgcaccagggctgggtgcgtgggcagttgtgtcagaggccgcgtgtgaatagtgactccgaagcctgccgcttcctgggaccatgtttatcccagtgtttatccctgttcacacacgtggttttgtttgaacacgtgactgttacgctttatgtggccttttgatttctccccacgcggttgtgcggtggatctggcggctcctcaggtggaggccggggccgtccattccctgctgctgggtggagatgttgtctccagttcctgcctttggcctccaggcacctggatttgagtgggtcagttctaggccacatcgtgcttgcatttgtgattcccgtggcccttatcaggttgctgcctcgaaagccttcctgccggccctgcagccacccctcatctcagccaacgccacatcagcgccatgggtgcaaagtcagagctcactgtcactcggatctgcatttctccacctctgcctggatttgctctttgggaattgtttctttgcatcctttgctggttttcggttgggtgagtcttttttttttttgagacggagttttgcttttgttgcccaggctggagtgcagtggcgcgatctccactctctgtaacctccgcctcccgggttcaagtgattctcctgcctcagcctcccgagtagctgagattacaggcagccaccaccacgcccagctaattttttttgtatttttagtagagatgggggttcaccatgttggctagtctggtctcaaattcctgacctcaggtgatctgcctgcttcagcctcccaaagtgctgggattacaggcgtgagccactgcgcccagccagggtgagtcttgttcttgtccttgagtgccacttggctaggctgttgctgctgaccttagctcccttgtttgccatcatggaggatgctgggagctccagctccctgtcctgtcctccccggcgctcactaaggctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcaggtacaagctctggggaccctgcatggggctcctggctatgggggcagagtggccatcgctgagggctgcgtggggctggactggaaaggctctgggggaggtgggtgctgatgtggagtctcttttggtttgaatatctcttttaccaagcaaaattgaaaggccatgggtcaagccagtacagatacaaaaataataagagtatttttgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctccaattgcagtggattcctcggggatagaccaaaggtaaggctgtggcgccctccttccccccaggctctgtgttggcattttgcactcctggagacctgtgtcccccgtgaacagcggcttcctccaggctggcttgttgccgggacaggtgggagcaagttccctgctgtgggctggggaggatggctctcaacaaaggccagtggttaagagttcctcactgaacgtgtttcctggggctgccagaacaatgcctcacagacgcgtggtttcgcagttctgggtgtgggcagggccgtgcgccctctgaaggttccttgggaggctctttcccaggcctgtctcccgttcctggtggcggccacagtccttgctgctccttggcttgtagcagcaccgcccaaccattctccctgcgaacatgactgttgacttgcccttcttataagagcactggtcctgttgacttagcgcctgccctgctaccgtgtgaccccatcttaacagatctcattgacaatgaccctatttccaaatacagtcaccttccaaggttccaggaaggacagagatttgggggggcactcttgcaccccttccctgtgctgtgtagaacctggtcctgaaagcctggcggtggcaccagctcggccctgagccggtgtctgtcctcagccgtgttgctgaggatggtcactgccctcaggtcactgccgcccacctgtgcccacgttcctgtggaatttcctaatgaggagaccctgggtggcgggcgggagctgttctgcctgtggtggcctcctttgccagtgggtcccatcagcagatcctggagctgtgtgtctgctgagatgctgctgagatgcgtcattgcaggcttccgacaaagctcactctagtcgtagtctttgttcagctttttcacgctgagtcgagtgagtctaaggatgtctggggagcacgaggaggacactcctctcctctcctcttagtgttgggcacctgcagagatctctgaagttcctggagtgtagctcgctcttctgccctatttgcttcagcctgtgtaattctttccggtgatctgtgcttaattcttgactctagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcggtgggtgtgcagcctcgcggtggcttgcagctgtgtctgtgtggcaggctcctgatggcggctgctgccgctcttcctgctgaccgggcctcatctgggtgcaggcacatcaggcgctcatgcagcgaaggccctgatccagggtggcagagcctttctttgttccaccagccgcacattctagatctctgcatcgagcagagaagatatgtggtgacggggtagcccctggaacctccaggagggattcaggcagcccaaggcccagctgcagaattggggccctcatccatgctgtgggggcggggcggccaggaaggaggcgacgctgggaactaaagcccctcctaggagaaaggcctctacaacagtgtctccctggcagcccagaggggcctggcctggctgcactacagtgggaatggaggggcccagagcccctgtcctggatgtgcagggcaggctgtccccagagatggtgctgtgcaccaggaggctccgccggttgacgaaggagctgcagctctggctctgtttgagggaaagtagagtgggctccaccttccagcacccgcatttcagagatgacaggcgccagtgggaaaacagtagcgtcttgttccacttggtgatgagacagtctgagaaatgggtcgtgagatgactctggcggtgcgcagacatcatggctcacacctaagggtgcagccacctccgttacaatcttgcagtgtgtcgccatgaggctcttgactgtgtggaatcacagaagaaaaattaaatggcccttacccaaaacaagaaacccaaaagaggccaggtgcgggggctcatgcctgtaatcccagtactttgggaggccaaggtgagcagatcacctgaggtcaggagttcgagaccagtctgaccaacatggtgaaaccccgtctctactaaaaatacaaaaattagactggtgtggtggcatgcacctgtaatcccagctattcgggaggctgaggcaggagaaatgcttgaacccgggaggcggaggttgcagtgagccaagattgcagaaagctgagatagcaccattgcactccagcctgggcgacagagcaagactccactcaaaaaaaaaaaaaaccaaacaaacaaaaaacaaaactataaaaagaaaatccaggccaggcacggtggctcatgcctctaatcccagcacttctgagaggccaaggtggatggatcacttgaggtcaggaattcgagagcagcctggccaacatggtgaaacctcatctctactgaacatagaaaaattagctggtcgtggtggcgggcgcctgtaatcctggctactcggaagggtgaggcagcagaatcacttgaacccaagagacggaggctgcagtgagccaagattgcgccactgctctccagcctgggcgacagagctagactccatctcaaaaaaaaaagaattcagatatttgtgtaaaaacatttttgtacggtaaagatgacacacgatagagaaaagtgttggccatgggtgcgagagggtggtccctaacgtgacagagcttttacagagtcatgccagaaagatgaatacccaagttgaaaatcagtcccttgggagagggcaggtcacatggaaatcagcacagcagcccctgcctgtccacgccgcgctgggggacactcctgcacccggcacagctcctctcagttgccgaaacataaagagacgctaacaggtggtccttaggggcctggcaggtactgtggagtcaacaggccctgccagggagcccgcccgggctgtggtagacagtttgtctgcccgtcctgttcgctggagccagcactattttgtgttcatttgacctgacagttgtaagtcatcttcaaccacgataatgttgaagtcgtgattccatcacttctgtgtgctcacatcttgtgttctgttgcagggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctgtatcatttttttgtactaatgtgaattgttcctcagaaacgcttcttttccatcctagtgagaagctggccctgcaggtggtggcagcaatggtgttgtaagatttcctcccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatttgggggataactttgtatatttttttcatttggcttttctttaccagtttctgatttttattctcaatatatttttgctaaacctatttcacaaatcaccaccgactgaagtgtgtgtttactgatgcggccctgagctccatggcgaaaggagtgactttgcagggcgtgagaccgcagtctgcttagagcacaggaagtgacaacttagggagccccgtagggcgctgcaggccccggggaccccagcacgtgggtctaaagagagacggagtctagctctcctgccacccagagtggcttccatctcagcactctgtgggtctggtgatggaagatgcagtctctgctgatcacatgtgccctctgccagggcacctactgagaggtgcggtcctgggggtggaggcctgcctggcaggtgtgcgtgcctcgtacgtgtgttatgggcactggtctaggccaggtatgacacccactctcctgtgagatttcactttagtttttaaaaggtccagttctacagagtgagacctatctatctgagtactacatatgttttaagacttggttctttttttgagggatccttgaccctgggaagtctggagcaccctgagaagggggcaccatgtgtgcctttgcccacgtgtcctgaggggctgcttgtctgggagggagggagagaacattcagcagcaggtgcttttttatggccttttcttaaaataacctaagggggacacatccatcttgcagagaagtttacagaactccccttgaaaactgctgctgaggctcctgttaaattttctgtggcatcttttatgccttggtaaaaactgcagtgtctttggacctgagagtggctactccgtggttttgtgacctgtaagcgtggggttcaggggtgtgtggccctgcagggtcccacgcctccctgagcactgactggaagtttcactggctggtggctgtcccttctcccatcagggtccccagcaaagttaactacacagaggacccaggggaaacgagctgtgtagccactgacttgctcgcgcggccgtggcctctgaggggcactcgccggttaagacagggtgggagtagtgctttccagttcagactctaacttctcccaaagtgtcctaagaaaatactggatcggctcatagatttatgctccttatgatgccctaacttggaaggttgttctagggacaggccgggcagtgtccccacacacaccttagagtcgaaggccccagggccccgctgtcacttgcccaaaagatcccttccggcaggtaagggactaccaatgcttacgtcaaaacagcagaatcggctttgcagtgcactttggggagcagatattaacttatttttgtgttggacagtagtgaaatcttgtgatttttaatcgctttgataatacttccaaattttatgatttttctgaaggaaataatgcaaacattttaaatatgtttctccccctttccaaaaactgttaaactaatgagcaagtaacactaactttgaatgtctctacaatacccgttgataactcagtggagccaggctttggggtagcggccctgagcttgcagggtttctcgccactggggctgaccacgcccccagctgtgaccgtgggtgtggctggctctcggccctgcccagctttgttctgaggacgtggtgacttcctgaacatcagcttcaatcctccatcattaatgtgaagcaaaacacaaaaaccgccccaatccctcaggattccttggcatccgaaaccagcatctgcacctaaacccatacccacccgtgtgcgcccacagggggatgtgtccgaatgggcagcttaaaatgtggtcacctgtgggggaaactcttcaggcacctgaagtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaactta

SEQ ID NO: 12 - DNA, 2898 bp, Homo sapiens
acgtggcacggcaccggtcccccttcctgccaacgctgcatttggctcgggcccggtccatggcggcccctcggaccctgcgctgagccccggaggccagggcgtccggggctgcgccacttccgagggccgagcgtgagtgtcgggaccccagggcccgacattgaggggatggcagggtggaagggattcggcctcagcgcgagggaggcgggcgggggaggggccgaggctcccagtctccctgcccggccctgggtcgcagtcctgggccggagctgaggccgcgggggagttggctacatgggtgaacttcttgtcccttcaggctgccggtcccggcggtgcgacacggccgggaggaggagaacaacgcaaggggctcaaccgtcggtcgctggagccccccccggggcgtggcctcccgccccctcagctggggagggcggggctcgctgccccctgctgccgactgcgacccttacaggggagggagggcgcaggccgcgcggagatgaggaggaggctgcgcctacgcagggacgcattgctcacgctgctccttggcgcctccctgggcctcttactctatgcgcagcgcgacggcgcggccccgacggcgagcgcgccgcgagggcgagggagggcggcaccgaggcccacccccggaccccgcgcgttccagttacccgacgcgggtgcagccccgccggcctacgaaggggacacaccggcgccgcccacgcctacgggaccctttgacttcgcccgctatttgcgcgccaaggaccagcggcggtttccactgctcattaaccagccgcacaagtgccgcggcgacggcgcacccggtggccgcccggacctgcttattgctgtcaagtcggtggcagaggacttcgagcggcgccaagccgtgcgccagacgtggggcgcggagggtcgcgtgcagggggcgctggtgcgccgcgtgttcttgctgggcgtgcccaggggcgcaggctcgggcggggccgacgaagttggggagggcgcgcgaacccactggcgcgccctgctgcgggccgagagccttgcgtatgcggacatcctgctctgggccttcgacgacaccttttttaacctaacgctcaaggagatccactttctagcctgggcctcagctttctgccccgacgtgcgcttcgtttttaagggcgacgcagatgtgttcgtgaacgtgggaaatctcctggagttcctggcgccgcgggacccggcgcaagacctgcttgctggtgacgtaattgtgcatgcgcggcccatccgcacgcgggctagcaagtactacatccccgaggccgtgtacggcctgcccgcctatccggcctacgcgggcggcggtggctttgtgctttccggggccacgctgcaccgcctggctggcgcctgtgcgcaggtcgagctcttccccatcgacgacgtctttctgggcatgtgtctgcagcgcctgcggctcacgcccgagcctcaccctgccttccgcacctttggcatcccccagccttcagccgcgccgcatttgagcaccttcgacccctgcttttaccgtgagctggttgtagtgcacgggctctcggccgctgacatctggcttatgtggcgcctgctgcacgggccgcatgggccagcctgtgcgcatccacagcctgtcgctgcaggccccttccaatgggactcctagctccccactacagccccaagctcctaactcagacccagaatggagccggtttcccagattattgccgtgtatgtggttcttccctgatcaccaggtgcctgtctccacaggatcccaggggatgggggttaagcttggctcctggcggtccaccctgctggaaccagttgaaacccgtgtaatggtgaccctttgagcgagccaaggctgggtggtagatgaccatctcttgtccaacaggtcccagagcagtggatatgtctggtcctcctagtagcacagaggtgtgttctggtgtggtggcagggacttagggaatcctaccactctgctggatttggaaccccctaggctgacgcggacgtatgcagaggctctcaaggccaggccccacagggaggtggaggggctccggccgccacagcctgaattcatgaacctggcaggcactttgccatagctcatctgaaaacagatattatgcttcccacaacctctcctgggcccaggtgtggctgagcaccagggatggagccacacataagggacaaatgagtgcacggtcctacctagtctttcctcacctcctgaactcacacaacaatgccagtctcccactggaggctgtatcccctcagaggagccaaggaatgtcttcccctgagatgccaccactattaatttccccatatgcttcaaccacccccttgctcaaaaaaccaatacccacacttaccttaatacaaacatcccagcaacagcacatggcaggccattgctgagggcacaggtgctttattggagaggggatgtgggcaggggataaggaaggttcccccattccaggaggatgggaacagtcctggctgcccctgacagtggggatatgcaaggggctctggccaggccacagtccaaatgggaagacaccagtcagtcacaaaagtcgggagcgccacacaaacctggctataaggcccaggaaccatataggagcctgagacaggtcccctgcacattcatcattaaactatacaggatgaggctgtacatgagttaattacaaaagagtcatatttacaaaaatctgtacacacatttgaaaaactcacaaaattgtcatctatgtatcacaagttgctagaccaaaatattaaaaatgggataaaattata

SEQ ID NO: 13 - DNA, 29442 bp, Homo sapiens
agttttttctcactgcttgcttggcaatgcagctctagcttctaatgcccttttttaaccctttaggtatctgatcgctttgccaattttgcgttactgggcaggctaagagatcttcttttaattcagcctgcttaagacgggaactgataactgtagtgtatcctctgccttttttcttatctattggaggaagctcaggtaagacctccttttcctctctgttaattccgcctggtgattagggcccagggaagacgaggtgataaggcaggtaatgtttcctcttcctgcccctttttaggcttttccgtgtgtgactgagccagggctgctctagttaaagcccataacgttaaagctgttactgggacttgctgcctttgcaactgatgtttttaagatctctccccacttgtttcccggagctctatgtctagcgttccttcttctgggaaccatggactttgggatttaacagtttgcattacagcaatttgtctagcatgcatgattaggtgccttaattgagcctgtgaaactgaagctccactagccttaagcagctgttgtaatacttttatataatgtttctgctgtgctaataactgttgtcccatgatgaaatctcagcttgaaccaactttccccagaacttggtaaccttgagtgggcaccaatgacttactagttactcactgacttgaccacgcggtttttcttcacctttgtttcctgggggcccgtcgcattcctcaggcttcctttgcagctttcctcatgaaagcggtccttacacttccttcatagcttgccttacaaggggctccaactgcggaaggtctgtttctgcagacccctgactgtcctcacacagctctcctcacatggggcaccaattgaggtattgcttctcacaacagggcagtagctacctgtgtctgcccgcagaccctgacccaaacgacggatgaataaaatgtacactgacacacagataatctgttttgccagtcatgctgagtgtctgaccgcctgtaaaccaaaagaggtttgtcactgcagcttgccctgagtagctcagactctaggagtttatttagtgtagaattaacaacagaagatttgagtaaacacacttgtggataattaacatggttaagagagtagttctaggaatgattaaaactcaggtaccctggtttaaagtaaataccattagggggcaatatccttggtcaaactacccccaagagggccatctgtctcaaaggttacttaatggaggtagggtaaacagatctaactggggaagcctgtgttgtccctagtatttaccctatgacctaatgctctaaggtaagaaatggctgccttcagcctgttcaattattacaagctttataacctttcaacctttcaaaaaggtttgtgactattccctataactttccctaatattttcctttaatacttctgccaccatcctgtgtgaatcccaacaatccagcacaatggtgaatagaatctgccagagcagacattcttgacttttttctagtcttgggaatgcattcagtcctatcccattaagtatgatgttacctctaagtttttcataagtgttcttcatgagatttaagaagttcccttttattcctaggttgctgatattcttattagaaatagatatcagctttaccaaactcttcttctatgtctattgagatgattctatgtatatatagaaattttaattattctaattggcttattacagtgatataattttcaaaagttaaaccaaccttgcataactggtatttacctgttagttcttgcatttatctttatattggcctgcagttttctttttttgtaatgtttcacccgtatattatagagctaatttttccctattgctgagccaaacttctttttggtattgtactcaatgccccccaaattatgatgtttttttctaggtctgacaggaacagcaatattcccagctctgtaagacctccagggattgttccttctactctttttagttagctggtttctcagacctaggtaatttcctcacatgcatgtgcagatcactactcatctaaagactcatggggaccctctctgtacagtcctctcctgcccttcgaaagctaaactcattggcttccctgaactcatttccttttcctcaactcagttgcaaatgagctttgcctggattctttcacctgcatcatggcctagagcctctcttcaggcagtaagctggggcagtcttagagtctggatcatttctttgtgtttctcaaggatcactgtccttctttgactaatgctcaatgtcttggaagccattttgaatattttgtttatttctccaggtttttcaggcaggagtgcaaattagttctctgttattccatggtggccagagtagaagctcaggatgctgctttaaaaaaaaatttttttccaaagtctttagttttaattagtggaaataatgtgctataaagggcttactttatcttggctgcccctattactatcaaatatataagtataaacataccagaaggtttcttaggcagattaagggcaacttcaaaatctcacaaggaacataatgtgaaataatgaatcgttataagtatttcctttacaatgaggaagaatacaggagtgctcacaattactgcctttatttagctggtaaataaaatttattttagccaatgcagtgtgataagaaaaattagtaaaagataatatttgaggattgaaaagaagggaacaaagcatattcatgaaatatccacagataatatcattacctatttttgaaactaaaaagatttatagataaaatattagaatgagtttaaagtagtaaacgggctaggtttaagaatgatatttacaaaacattggatttagcttagtcaacaatatcagaaaatgtaataccccccaaattgttttataatgcctagaaaaatattatttacctagaaataaatgtaaaaatgatttgttaaccttttatggagaaaattattttgttgaagacacaaaaatgtgacataagtcaatgacaaggtatactaatgagtaggaaatctcaaaattaagacagtagttggtgaatatacagaaaaatataccattggaacagaacagagagagtagagacagactcacgaattataagaaaatatctttgtattagtttgtgctatggtgtgaatctttgcatcccccacaattcatatgtttaaatcctaatctccatggtgatggcattaagagatgggtctttgttgaatgattagatcatgagggctctacattatgtattttgttagaaaagttcagactagacagactattaggggtaataatgtaccacagactatatggcctacacaactgaaatgcattatctcatcgttctggaggttctaagtccaaggtcaagatgtcagcagagttggaacctgttggtgctgtgagggaaagatctgttccaggactctctccttgatttgtagttggccatgtttttcctatgggtctttgcgtcatcttccctctgtgtctgtctctatgtctaaattttccccttttctaaggatatcaggggtattggattaggggcccatcctactgcagtgtgatcacattttaactaagtttatcaagaagaaatgtatatcccgataaggtcacattttgaggtactaggggttaggactataacatgtgaattatgaggggacacagttcaacccataacaatcttatgttgcaaacctggcagtacagatcagtggagaaaaaatgaacaattcagtcagcatcactggagtaatttcttatctatatgcaaaaaatagaaagtgatacctacttcaagctatatacaaaaaattattccagattacatacttgaatggtaaaagcaaacatttgcaatttttagaaaacaacagaatacatcctttgaaagatgttgtaatgacataaaaagattaataaacttgacaacaataaaatgaacaactcctgttctttatgacacctgagaataaaaaatcaagaagaaactcagaatacatgtttaacacgtatgatgaataagcaatttatgtctacaatattaaattacttctagaattaatactaaaaagaaaaataatccagtagaaaaatttgcaaaacactttggaaggcagaggcaggcaaatcaggaggtcaggtgttccagaccagactgtccaatatggtgaaatcccatctctagtaaaacagtacaaaaattagccaggcgtggtggcatgcacctgtagtcctagctacttgggaggctgaggtgggaaaatcacttgaacccgggatgtggaggttgcagtgaaccgagatcacaccactgcactccagcctaggggacagaagagaccccttctcaaaaaaaaaaaaaaaaaaaaaaagacataaacattttagagcctgaagcatgaaaaaggaaaaagggttcaattccattagtaattagaaaactactgttgaaaccctcaataagatgccctattacacccacagaattggcaaacattaaaatatggataataccaagcttcaagctttgatgaagacatagaataatgagaactctcatttctcactggttgaggtgcaaggtggtacaaccattttgtaaaataatagggcaatatctattataataagggagattatgcattttcttcttcttgttctactattgcctcatgttttcaaatatttattgctcaaatctatttctgaagttgagcatttccacttttacatctacacttgagagacacccctgcatatgtgcaccaggaaacatattcaaagatattcatagaaaaacttgccactgcttttagcagaaaacccctgaatgtgcataagcagttgattcttcagtgaattctctctaactgtaaaagtggatagagaatttcatcaactacaatgaacctcaaaaaagtagtgcaaatcacagaagaacaaattcagctggatgtgtttatataaaatcaaaccaagcaaaacaaaagtttactatttatacctttactacatatatatgtctctaaataagtgtaagacactactaattttaaaacaaatttagacttagtggttgtccttgagaatgagaaagggagataagatgaaggagggacacactgtatgcctctaatgatttgtagtgtgctattttttaagttgggaaagagatacatggatgtttattatatgaaatattggctgtcataaattgcttttgaatgtagaatatgtttcatagttttttaaaaacacagtgtataagaggtaaaggaagaacctgagaagtattcacaggatactagcttgggtagtcaaatggataatgacaccattgtcagattcagaaacacaggaagaggggcacaattaaattttatgactctggttttgaaggggttaagagtgaaatgcctctgacatatccaagagtagatgtcaaagaggcaacaaaatattaatatctggaggttagatgagaggtcagtgctgcggagatagatttgagcaataaatatttgaaaacatgaggtgacgggagagcatcaagataaaaaggaaatcactattcctataatctcagctcattccattgtacctacctactaaatgatccaagcccagctgtccctcctgattttactccctccaggcttattcctctatttatatagattagatccaatacttcaggcttcacaatgatttccttctgagttatgaatatgtattatttttctgattatttttagtcatctatctgggttgtcttatagctcaccaagctattcaatgacaattattttaaattcattatgagacagttcataaactattatttttttaggttcagctattggttattttttttttcctttggtggtatcatttttctctgattgttcttgatcttgatttttaggcagtgcattagtgtctgcacatttgaaaaacaagaaacttattctagttcttgcataccggctttatctggaaaaaccctttcctagtcatccagcaactctttgtagggtgtctagtgtggtctgcaggtgaacttgttgccaaagtcctcaggcaggctggcctggtgcctgtgttagcagatggtaggcctgtttcctgggtctgtagagttgggcctgaagcctggatcaactggggtggatcttttcattgggtatgtggggatgaacgtaaagccaatttctataagggcaggtacagagcctgttaacagtaggtgctggactgagcatgggtccacaggggctaacatggctctgaggcgtgcattgagcctgtgtctgcaggggctggccagattttggaatgagcatagtgtctgagtctgctgggataagcctggcatctgagtccatggggactggcctggtactggtgcaggactggagccggaatctggagaaatgggcctgggatcttggtagacgggggcagacctggagcctgagtcttcagagatggtcctagagactttgtccatgatggccagcctagcaacagggtctaatgaagtcggcctgtaccctgggtctgctagagcacagctgggccctgagtttgttggatgctgggttacaaaaaccagcctggagtctgatgctggcctagggctgtggtgagatggggccagtctaaagtttgagaccataggtgctagactggtgcttgtagccacaggggtgggccaagaattgtggaatggcctggaggctggttgtgtgagatctgtcctagaaccaacatattcagaagtgggcatggacactagggccacaaagggtggcttgggtcctagggctgtaggaactggactggaacctaagtccacagaggcagtactagatactgggtctgtaggcacctgcccaatactggagtcaactgtgatgggcctggaccctgggtctgctagaggatgggaccataggaactggcctggagagtggggtggcagaaactggcttaggcctcgggaggcctggagcctgggtctgcagatgcttgccagatacctgactaaggcctagggctagggctgccaacctggaaatggggtgggcctgaatcctggattggtgtgagccaatctagttctgggccggtctggaacctagggtggacttggagtctgcgaccacaggggctagccttgtgctaggcagtcctcgagcctgtatccacaggggccagattaggggttggatatatggacactggcatggtgactagagttgcaggagctagcctggtcctggggctggcttgaaacctggagttgtcgaggccggccttgttctgggagcagtctggagcctggagtcactggggctggcctggtcccaaagactgtctgacatccaaggcactggggtagacctggcatgaggatatacccagaaaccaagtccaccaggcaagcctggagcctgggctgtgtgatctggtctggcttagtgtgcaggtactagcctggagtttcgggcaatagtcgcatacccattactggattttactgaagcaggctctgcgttggagtccaaggcaaagttcagtgctcacttcacttttcttcttcgacacagagattgcctctctctgtgccctgctgcctggtgttgtgggaggggtgacacaggaaatgaaaaattgttcttcctatgctcttcaattaatcttttcttatttctctgctacacaacatttctgtaacctttcacctggttttcttagctcttctgaaggtattttcatgcatagatagttgtttaaattgatgtttctgtgtgaggataaatgctagaaagtcccattctgacattttgctgatgtccagtttcacggcatccaatcagatttctatataacgattgtcaaagtggctcagcagcatcagagacaggtctcctgctaatttggaaagaaagattgcagatcttatgttaaatgatcttatcaaacacacacatatatacacacaataataataataaatagagctgtcaaaactttaggaggtgatgaatatgtttatggcttttgttgttgtgatagtttcatgagtatgtatgtattcacctctatattcatcaaggtttatatattaaacacatacagctttttgtatgtcaattatacctccataaagtagttctacaaaaaaataaataaacaccatagaggaaaaatacttttggcctctttctccatgaagtatgacttctatttcaggtttctggtggttactgaacttccagattttctgatgataagtataataagagaaataatatgttaggctagaaaagacaaaaatgcaggatttgaggatgaatcaatcaaattttttcataacataataggacttattgttcaacatattcaagccagtaccaggctagagtgagagaaagtttccagatcaaatatttgtgtaaactaattcaactaaagtctcaagaggaagagattcatgatgagatatctggagtcacaatgtgcaaaattcatcacaaagtggaaaccagcatcttacaatacaaagaacaatggcttgggattctgagcatctgggttctggtcttggttttgcacatgcaatcatgtgtccacttcccaggacttagtttcttgaaactagacaatctctactaaacctcctatctgattttcctccctttcaggaagttaggcaggtgctcagatcagctttttggtcacaaaggatgaaggaagaaggcaggtgtctttcttaaccacagttttgggacatggctttagagaatgcattagcagggactaagcaaataatgaaagctgaatttggggtagaaaaatggggaacaggagacgaaagaatcagaaagaaaatattaaggagcaacaaagagtcccctattgatttgtagtatagccaaagttttgtttttctcttccttagactcttagaggactagaagacatcagagagctttaaaatgttctaggatgccaaagccaagaaagcatgtcctgtggatccgacaccttctcagttccctgatctagctaaaaccaaataccacttgctgatttctccggaggcactgaaacctcatcaccaacccagaacagtttagcatgacttgttctctccatgaagtccctaaacatcccccttcttcctctctaaaagcttcaagaatccactttcatgtcaagtttttctacagaggcagattgttgtttatatcaaactccagaaaccctcatccttttctgatatttatttaagttggtgctgtcagtcttttctaccataaagaacctgtgtttacttggctcttctgtgtcttgccaccagccaccagtcagttaaaacagctttcttttgctacagagaggtgcagccacatctaaagccaccagcagtgcaaggtcctctgactgcattaacaacccctccctgagtgtccagatatgaagaatctgctcaatcaccaaagctcctgaattaagagttaggatgctcctttggaccttcaggaggaacttcattaggaattctgagatagagcaagcattgctggggaaccacaggtcccagtgtcctcctgtcatctcagaagccagtaaagaaaccttcttccctagaaagacttctggagagaaaaaaattccccaagatttgagagcatgagagtctcatggtgaggtccctggtgaacagaaatcagaaaagtactagtacacagaagagatgtacaagcatctagtcactgcctcaaagtaactttgaatttattatgacttagattgagatagagtgattctttgactgttcggtccgtgcctgaaacaaacatgattaatatccataatcttattaattttattatccctaggaggcaaagtctccaaagttttccaaatgatcttgcaaaggcaactctcctcagattccctaggaagttttcagattttatgaataggtgccaacagctatcagatgtcttccaacgatggctgctgcatcccagtttcacattgctaagggttaaagaaggacattgatatgaaagaagcatcccagagacccttgacacattgtgagagtacacagagggtggggctccatcaacctcccacagacactcagccatactattcccattccctgccatgagcaagagtttcagggcctcacaggggttcaaaggtggccaaatcattgccactctttgtagtatgaagtacaccaacacgtaaaggtaggctaaacattgataatataatagctttaaatgtgtataaatgtatgcttacaacctcaaaaatgccatgcaatattattgttctacttacaagatcagtgcaggaattataaagcattaattcagagtggactcttggcagtgtgtaatttatggtgcatgtgttctccattctgtctgtgtttctgtaccattgggtgataacactagaatctcaaatttgggaacttttttgaaagtggggccatgcctaaatggtatcctagttgtctcttccaccatgaccccatgatggacctgcaaagtcccaaagatggaagaacattcaggggtagccagctggagagacctagaatcagagatctctcacacagcctgaaaagcccaaagcagatgagcataacctcagcacctgtgaaaccagaattcattgcttccattcagagatcccatgttcatgtcagaatccaagctgccacgagtgtttcatgaagtcacttatgactaatactgagtacaatgggactgatatcagaactaagctaggcccggagagccctgaggttgtgacacataaggctaaacctttgagttttgatccacagagtagatacatcagagaagtggacttggagaatcccctgctggagtcctagagagtaaccactctgtcagatagcatgtgtttctgagaggaaagcacaggggtctagttccagccgtatccctctgcaccccatatgcacgtgctgagttctagagagactccagagctggtctgaaaggctgatgcaaaggagtctgctctggaactgaagtgttataagaaactggcaagctcagcagccctacagataggtgaggagcccagagatgggagaggaagctattctcctggccaaggtcctgattcagtttgccagaatcataggcagacttgaggccgactggagctagcactggcagtggaattgaaacctcccctgtagtcccatagagaattttttttgtataaacatagaaattgacccttctgatcttaatgcttgaaacttttatttgttttatatgaatttcatccttagtaaaggacccctacgtccctcaaaaagtatcaaagaattgaaactcaccagatgatcccatccagacaatgggacaccagacccctcataaattatgattgcttccttaggtcgcctgagttcctgtttttctacacattgttacatttcttcactgctatgaaaactcataattttagttgatcagcaagacggatttgagaccgagcttgcatctcctctgctacagcatccaactcagccttcttccttggcaattggttatattgattggctttctgtgtggtgagctgcaggacctagaccacacccctggtgtttcagtaacagcttttggtttcccgaccaggaacactttggctcagttgccatgggccaggagtctcacagaactactaagcagctgcttacccaattttggctggagagataagtaccctctggggccaccacagctggccccaaccatggtcctgattgccttggaagaactgcctttggaatttcacatcggcatccagataggtgactgtcctttgtgggcccagacagaaagatctgctcctctcagtttgggaaatttttaaaggaatttccacttgcgggttgaataagcccaactgacgaagagaggaaaataccctgactgtttcagtatggacattcttgggggcttgtttgtcattgtgtgtgtgtccaggcaagtgagtgtcttttgtgggtactagatagtgggatcagctcctctccatttgagaaattctgaaggaattttgatttgcaggttgattgagcccaaccaatggagagaggaatcaccccaactgtttcagtttgtagacttttggggcttgtttgatgctgcaacagttggattgttttagtgattgtttgcaagtgtctgatatagtcatcagaaatcagaatttaataaactgacactcttttgtaacactgtttgaccccagtatagtttggaatctggtatttgcccttgaatgggaaagtgggttggagttccatgtatccaggcttttgtgctgctgctgttgggccaagttagtatgtgatattctcctgtggtgctgtttgaccccagtgttctttggagtctggagaactttggactttaaaaattaaactgccacggaaactgttttactgaaaattttggttcacagccttcactggattacctatcaaggctaacaaagttcagccatgtgaacatgtttgcagactgatgagtttctatttcaatagctagagttccaaggtaaaagctattggatctttgggtgtatgtatgtctagatgtgtctttgggtgtatgtatgtctagatgtgttaatgtgtaggcatatgtattacgttaaatgttgtgactacccaattggattataaataaaagagtgctcatagattaagtaaacaagtccaaagtatttttcatgttcatgctacttaagtaaatctttagcaagctagcattaaaattttgtaaaataaaactagaaatgtcatcatagttgtcagcatacatttttgtctgggttttgtatttgtttctgctagatattttgaggtatgagagtttggcacagaagtttataaagttgtcaccaggagttggagataagcctgggaaacagagaccccctcccccatctctataaaataaaaattaaacaattagccaagcacagtgattcatgcttgtagttccagctactcaggagactgagattggaggattgcttgagcctgaatgatcaaggcttcagtgagtcttgattcagccactgcactccaacctaggtgaaagagcgagaccctgtcaaaaagacaaatagaggcagagaatgacaatggggcacagaagcattgcagggagactaggggaggagtagtaattttttttattattattacactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccacgtgttctcattgttcaattcccatctatgagtgagaacatgcggtgtttggttttttgtccttgtgatagtttactgagaatgatgatttctagtttcatccatgtccctacaaaggacatgaactcgtcattttttatggctgcatagtattccatggtgtatatatgtgccacattttcttaatccagtctatcatttctggacatttgggttggttccaagtctttgctattgtgaatagtgccgcaataaacatacgtgtgcatgtgtctttatagcagcatgatttatagccatcccattactgggtatatacccaaaggggaggagtagtaatttttaataggatggccaaaggaggccttattgagcaggtggcttttaggtgaagacttaaagaaggtaatagagtttttataggtctaataagaaaacagaatgcaggcagaagaaaaagaacagccaagtgcctgaagcagagaggccaaagagagtgaggtctaggacctgactggacagatgtcagggaggtgactggagtctaacttagagaactgttataaacaatttgtacctctttctctaaatgagattgggagttgctgcaggagttgcacaaagacatgacaaaatctggcttttgttttaaaaggagcatcctcatttgttattgacggaagactaaaggcattctccatccagaaaagactgctaagaactgtgaagcatataaaagtttaccctacttggggcaatgtttcatgaatgctgacagataacacaagctttctgggtcaaagacagagttttatgactcattcaacagggagaatgatttttgtgtttgtgtcagtcatccttgctccacaagtcctacagaggaaatacagaaaggcagattaatgttgcaagtgcaacagatgtgtgttgaagccaaggaaccctgaatttaggtcacctggatgttttataatgaactgcaagcaaacctgtctgaactttgctccagagggggacattatctttcttatactgatcagtaagcagacctaccctctgcttcagaagaaagcaatatctctagcttccaagctgtcctctttagaaacatccttgaaaagatagtcaggagaaaaggctgtcaatgtctctgctcataagacatacagaaatgtgagaggccatgaagaattttctcccagccagaattagcaggatgtcataatggattggatgtaaagtgggaggggaaaagatacttaagaataactccaagaatttttctttgaacaggtgaagaaatggagttgccatcaactaagttgagaaagactacaggtgaagtaggctgggtggagagggtggataagaagattgatttgagacataatgagtttgagatggctattggaaggaatccaagagatgtcaaacaggccgttagatacatatgccttgagtttggaaaaaatttgagtagtaatttaaatgtattagtcattggcaggtagattgattttaaagctatgggaccagatgggatcaccgggaactctgaagtgatccaaaattaagaaactggggaggaaagaagggtccacagaggagactgagaaaaagtagtcagtaaagttaaagaaaaaacaagagagtgtgttgtcttggaaaccaagtccattaaaggatgatctattaagatgagaagcaataattgaccactggatttaataacacagagatccctgatggttttaaaaagtgtttcagtagaatggtagcagcaaaaacccaattagatgaggttaggagggggattggagatagcatgtatagacaatcctttcaataaattttgctacaaactgttgaaacaaactaattacagcctgagaaggactctgtacttcttcatttgagtccttgtgggtaaactgtaacgtagcttaatcatcagacaaaattgaaaacctaatttagtagtgtgcacctgtaacaatactccagtgttggccaatcccagcagccatacttcaactactcatagactgctgaatgttcaaactgtgttcaaataaggcaagcgcccagttgtaaccaatctctttgtttctgtacctgatttctggttcctgtacatcactttaccttttttgtctataaattcattttgaccacgaggcacccccggagcctcggtgaatctgctgtgattttgtaggctgccggattcacaaattgtttgttgcttaatgaaactcctttaagtttaattcagctgaagtttttcttttatcagatggtgtcacaagaaggatctgaagtggagcttctagtatccccaggagcgcgaagtgaacacggaaggtacctgcaggatccaattgtgtccattgatctctcagagtggctgaggataataggtaagctccctctcgcattttggagcttcacacgttggtgttttgagctctctgagttgcttggagcaaatttctgatccaaactgggtttggagtcacaacaggaaacagactgggtctaggaacagatttgatcttggaattaactggcctggatccagttagaggcctcttacatctcactgggtcagaaaggaactggtagtaagcagtaatgttgcaggagttataaaatttggcttttgaaaattcacagggatttttgtgttctacccctttgtttcttttcttttcttttttttttttgtgcgcctaggtaggaaaaaaatcactggctaagttcatcaagagaacctaagaataaagacaatattttagataaaaatgggatccttaatttctgtaaaactgagttccttctggcttatacattaggactgtataccaagtcttacagaaatggcaaaacattactaaagatacttagagtggaacattccaaatgaacaacaatgccaatgcatttaaacaacaatgccaagtacatttataaatgagggctctcagtaaagtctctttgactaaaaacagttttggcactattggatgtcaactgctattctttttggaataatctgccttgcactctttgttgactgctgtgggtgacaggatgaggcatgtacagaattgtggtgaatggggagctttttccttctccctacaaataaagaaacttgatagctgatgggactgtggggaaaaaagaaaaaaatatatagcatttattctgttttcataattctcatatttaactatggttccattgccttccatgtttttttcaatcttgcataaaaataaaaacatctcaatggtacaaactaaaattctcaaataagaaataaatcacacatactttcaccacccaaaaacaattttcatgtttatttattcccttcaagtccttgtccacatgcaaacataatttgggtacatatgtaaaagttatatattttgatatttttacccattattcattataattgcttttctgtagtcttcacagtgaccactgactgtgtgctactcatatttacagactgtcattcacaaatttataatttctctttagtggacattaaacttattttccatatattatgaaaaattattttagttaaggaatgaaattctgatacataatacaacagatgtgaaccttgaaaacattatgctaagtgaaataagccagacccaaatggaccaatatcatcggattccatgatatatgaagtacccagaataggcaaattcctagagaaataaagtaaaagttattttatatacatatataaaatatatatattatatataggggtatatatatatatacccctagccaggggctagggagagagggaatgagtaattgtgatttcatgggtatagttgccatttaggatgacaaaaaggctctggaaatggataagcaccatgaatgtatacaataccgctgcattgtacgcttaaaaatggttaaacggttagttttgtgttatgtgtcctttacaacgatttttttaaagaaggtggggaggggtctccccaggtttttagcagcttcctgatttagaaaagaaatgttgatggtaggaatacaggtagagaacacttttatttgggtagatgttagaagctgaggccagggtggggtcacaagagcaatattaagtatgaggagaggccctcaacaaaggtcattgcaaggggatggagtagggaatgcacaggaggggtattttggacaaagattggcagctgataggtgtggggattgttctcatgtatcagcccaggatataatgttcccagggcaaatggaacacaagtttttttgcggggagtgatatagcatggtagatcttgaattaaaacttttaaaatcttgaccaaaagctcaaaggagaagacaatagtgaaacacatgggtatgggcaattttagttaaatcaggtgagaaacagagcaaagaaagcacttggagatggggggaagaaaaagaccattttttttttgacagctacaagaacagcagagtcagacaggggataggctcatgtcagagatccagttttatttactaaaagttccttgggtattcaaacattctgaaattatgagatcttgcaaaaggatgcctttgtttaaacattgcttcatctagctacagaacatagtttaactttgaggcctttgaccccagacaagataaaatatgtttcaccttgcctattacttaacacatatttgttaactattttaacttcatggataaaaaatttcaaaaatctgtgttaactgatttgcaaatgattgtttcaaatatctgattcgtgggttccttctcttacattaattttgttgtaagttcttcacatttttaattatttttacatcattgaatataattgctaaatctctatatgacatgttgattaatatgaagtcaattaaaaaaactaacatatattaaaacttgttcttactttattccaggcataatgctatgcattttatacatattacattgtgtaatctcaatcctttggaaaacatgcattctaatttccagttccaaagttgtgagaaaacactttgaggttctgattggttaagcaacttaacaaagaagtatgagatggaactaaaatttgaaatcagcctaagctttgaacctatcagttgtgatgatcaccttctccaagttattgttaaattattggcacatttctaagaattctgaatgatatttcaacaaaagtttacagatatgtgttaaaatttttctatctgtttttaatttttgtaatgaaactgggataagttccaaaatggccgtaggtttgaaatatttggccctgagaaactaaagaaaatctatgcctactcctgctccaagttttttagtcatacctgttcttagagggctgatattttctattgcagatgaaagaagaattctcaggcatataatgaccaaaatacaggaaaaaacttatgatggtagtggtggagtgttctgttacaggcatttgggaagctcacagaactcttaatattcacttttaattctttccacaagggaggaagggcatgggttttggagacagtcatatatggtttcaaaatctgactctggcatttatctctaagaacttgagaaatttacttagtccctctgagatttggtgtattcagaatgaatatgatactaacagtacctacatcacgagtgttacttgaatggagatgtataaagtgcattttaaattcatttgtttccttaacattttcccttcatttcttatcttttcagagtttcttcttcaaggtctcaaggtctgaagcatcccacagaatgatcctactgaataactcccataagctgctggccctatacaaatccttggccaggagcatccctgagtccctgaaggtcagggaacagtgggaggtcagggtatgggagtaggggtgttgaggatgagaaaatagcaggcttgtgattctagtccttcctgactgtttgcagagggttggagctgggaaacaggatgggactgggggcacaggctgcatatcaagagctgctgcttctctttgggaagaggcagctaggtccactctgcaggttttgccactcatttggagaggcagtggagcatggtggctacgaacatggtttggagcctgtctgaatggatatgcattccaaggctgccattttctagtcagatggctttgtggatgtttctttccctttctctgactttacgtttggtttttccatcaatgagatgggaataacgttagcacctaccgcttaaagttgctatggacactgaataaatctatacaatataaatgctaagagcattgccaagtgcccagctagtacacagtagctctttggtatcacaaggacagtcctacctgtgagttctgcctgcttgctggtaacttcacgtccatcagtatggtcctctccaggaccatactgctcatctcaccatcactgacttggtctcagtaccttctcttaatctccatttttctcttcctcttcacaaccagatcctcatctctggggatctcaacctctcctggtccctttcatccctccttcaggtgtatggctctgtgtatcacatcaatcacgggaaccccttcaacatggaggtgctggtggattcctggcctgaatatcagatggttattatccggcctcaaaagcaggtaggcacacagacagggactggtggagccaggcaggtccacagggcctgaggaactgaccagttcagacaccatggctgcttttatagggtgaaaggaaacgtgagtattttaaaacactccttcagtactgggcaccttgcatgagtgccacgtgttcccacccttcgtgtaaagcataggacccttctgggaaagggggtggaggaggaaagggaggaaaaggacaaggctgacactcacagattaagggccctatgaggtggcaggggtcacctgcaggggctgaaaggaggccaatttacagggaaagttgggtgtctgagatattagaacagtggcttagaaacagaaaccaaggcataagtctaccagtaaaattacctctcagggccaggcatggtgtcttctacctgtaatcccagcattttgggaggccaaggcaggaggatcacttgagtccaggagtttgagaccagcctgtacaacatagtgagacctcatctctacagaaaataaacaaaattagcagggcatggtggtgcatgtttatactcctagctactcaggaggctgaggtgggaggatggcttgagccccagaaggtcgaggttgcattgagccaagatcacaccactgtactgaagcctgggcaacagagtgagaccctgttgtttttgttttgtttttcaaaaaaaaaagttacttcttaggaaccagggaagggactcataattactgtgtgtcaactgtgtggaagcacttctctcgttagtgaatgttatcatcagaacaatcttatgaagtgagcattaatatctccaatttacagataaggaaacaacattgagaaatattaagtcatgtagcggctggattcctgatgttaaagcattgcccagtctgaattcaagtgcagtggactctaccacttttactagctatataaccataggcacttctgtgagtttcatcatccgttaaaatggggaaaataagaggatcttcttcagaggattacacaaggtttaaatgagatactgtatgttaaacacttagtacatagcacataactgtaaatagtgtttacaataattagccattattggctgaggacacacaaggaataaatgatggagctgaaatggtaatacaaacctaggtgtatttttttcctaaatacttcccctttgtgtttgtgtgtttcatacacatctggttagtaaactgaagcctcattgccagcccaacttcatgtaggtgtaaacgctgagcccccaaataataataagccacaccaggtcaagactagtttgcaaactgggtcaggattcggatgcagaaagtgacaaagtgaccctagcttgaggaacaaaggggtaaaggggatgggaaccaggctgagcctaacaccttcctcagggatgttcttttgatctcctggcttcctgacaatttgggatcaaagattaatgtttagtttatttaatcaatggtccaatttcttcaaagtgtggtatgctagataactgtaggaagtcaaatagttccttttacttcagtaactttgtagttattatatgtattttagcaacgtaactatagcatcaagccataccttcatgtatgcattgctttgaacaaagttagtttttacagtgagtcaataaacaaaaatatgaaaatataaaagtcccacaccacacatataagaccaaaaaaaaaacaaaaaggaaagaatgaaatacgctgcaatttacttggaagtgcattcacctagtctgattccatagcataccatgtttctttcagtattgaaagtcaatctgattttgaataagagcttttcagggtgggatgcaggagaatttatctagaaaaaaattaattttttcattgttgatttttaatcacaaagataatctatgttgattatacaagtaaaaaaatccaacatgattttaaaaagttaataacctcttacctcccctcccctcctctcctcctttcctaccccttggttgtaatcagtgtccttgcccatattaatacacagaaggaatcccagcactttgggaggccgaggcaggcggatcacgaggtcaggagatcgagaccacggtgaaaccctgtctctactaaaaatacaaaaaaaaaaaaaaaaaaaaaaaaaaaattagccgggcgtggtggcgggcgcctgtagtcccaactacttgggaggctgaggccggagaatggcgtgaaaccgggaggcggagcttgcagtgagctgagatcccgccgctgcactccagccttgggcgacggagcgagactccgtctaaaaaaaaaaaaacaaaaaaataaacagagggatattcactgatgatctcttttgtcatcactcttaatttgcctttaacatatggacatcactttgggtgaatcaatacagcactaaagtattcgttttaataactgcggcatttcatagagtcaatgcaatgctatttagtcaatcattctcctgctgttgggttcaaactgttcatacttctttgccactacaaacaagcttcaataaacatcttcatatacatatctttatatcctggaaatttttctcagtacaactgatttccaaaaggaatatctgcaagttacagtttatcttattctaagcaggcaatgccaaattaccttcccaaaggattccacaattttatttttattagcaatgtatggaagaattgtttccccacattctcacgagcactgaatattatccctcttttaatttatcccaaactggtgggtgaaaaatggcatcttattgtggatttaatttgcatttccctgactagcgatattgaacatattatattttcatgtttctcggtcatttggtgtttacttttgacctgtttatattctttgaccacttttacactggggttttgtgtcattcttaaaattttgtaagtgttttggaaactagggatactaaaaaaaggtgtatgctacaaatttgttgcccaatttataattattttctattttattgatggagattttgacattaagaaattttttattttcatgtaatcaaatatattatctttttcactatgacttctgaggttttgggtttttttagttaataattaggaagatttttgctactcgaagatcatacaactgttttctcattttgtcttacagtgagttaattgttacttttgacattgcaaacttcattctatttggaatatatttttgaatagcatgaattaacattcttttatattaatcttccttatggctggctaattatgttagtaccatttcttaaataagtcattccctactgaaatataaatgtctattttgtcgtataacatgttatatatttttgtatctgtttctgtattttttctagtcttttctcatgctatttcattgtttctgtggtaaattttaatatctaataaagcaaatcacccttcaccaatctttttttactttcctatttcttataaacttaatagctatatgaacataaactaattcttccagttccccaccaactatcccaaataactattcgagttgtgattggtattggaggaccatttttcgacaattttggaagaattaatatttttgtgacactaaattttttcatcaagaaatatggtctttttctcactttttttcagtttgcattctatgccatctggtaaaatgttagtgttttcctgtgataaactaagtgatttttccattaagtttacccttaggtattttatactatttgttaagattattaaattattttcctgttatatttctgagcattattattttgttattgctttgtgtttgtagtcttgatttccaaatatgtcccactgttgtttaaaatcctgtttgtgtggggcattatttgttttgtttttttgtcgaagtctcttggattttctaaatgtgtaatactgtaatctacaaacaaagtaatttgctgctgctttgccagtatttgtatgggtttttagtttcttgcattattgcataatatgcaacctaaggaaacaattccaactaataatagttctatacttgtctcatccctgattttaaatagctataaaagcttacatttggaattacatttgattctgtatttgcaggtttagagcattttcctgttgctcctactttcatagaacttatatttagaatggagggtaaattttatgttatttaatttttgtcttttctatttggcaatttatacactcatgtaatttttttctcctctaatttattacactaaaagaccttccaatcaaagccatcctggcctttctaaaaccaactgttcatattcacattttttgtatatgctactgaatattttattcataatttttgtatctgcatgcataagggaatgttgtcataactctctttttgttatttccttaccagatttggcattaggatcttttcatctgttaccaaagtctactattaaaatcatgtgtttgtttttggcttatgtagaatttaaatgtaaaataatctgattttggctacattttattttttaatttcaacattctttttaaatacgggggtacatgtgcagatttgttacatgggaagattgcatgatgctgattcttggagtatggacagattccatcatcctggtagtgagcatagtacccaataggtagttttctaacccagccccttttactccaccctctggtagtccacactgtctattgttcctacatttatgcccatgtgtggtcaatgcttagctcccagttatgagtgagagcatgtgatatttgattttctgttacagcagtaatttgcttaggattattgcactgtggaaagtagtctggaaatttcttacagaaattaaaacagagttgccatccgatccagcaatgtctttactaggtaaatacccaaaagaaaatgaatcattctaccaacatgacacatgcacttgtatgttcattgctacacagttcacaatagcaaagacagggaatcaacccaggtgatcatcaaaggtagactggataaaaaaaacttgatacatatatttttatggaatactacacagcaatagaaaataataaaatcatgtcctttgtagcaacatggctgaagctggaggccataactcttgtctactttttaaaaggtagatgtttaatttcatttctgatattttctattagtttgttcaggatttctatttttttgcaagtcaatattgatagtttattcttgagggataacatccatttcttttatcagtaaatatcttgccttggagtagtatgtagtcttctattagaagtcttttgttcttttctctgtttcttctgtttctgttctcatagcttacagtctgttttttttttttttttgcttttttctctttctcttgtatttcttttaataaatgccttaccagaagtttatctctctctttcttcttctctctctgtttttgccatttaaaaatgaacttttggctttatatatcctttgcactatgtcttgttctccatttcattatttatagctttcatttttacaaattgttccatttgttattttctagtttactttgatattcttttatatatttccttgactatttacttggctatttttggtcattcttttaaaatcaggtcttttaaaacatctactcttctaaattcactgacgttttgggtttgaccatattcaggaacttgcatttataaaagcaccctgaaattcttgaaggtttctttaaattaattacactattttctctttaactctttagcaatacaatttccaacataatattaatacattcactgctaaaacgctcacacttattgtttatattttcccagagaaacatcctcatcttccaatgaagtttctgtcatgccagaatgggatcacgagtctctttctttcaaacccaagagtctaacaccacataaattacccagagagctaccaaaaaattcagttacatcattctattttgtgggcttctgggtgtaaagccagtgtcacttttcaaataggctgatatcctgtaggcttgagaaaaggcaaggtctcgttagtgtttatattcactaaagtatcttgctcaagccctggacaccgtagattctaggacactattgactctaggtgtctggtgaaacagtaggcactaaaaattagagaaatcacagttaaatttattttgagccaagtttaaggacttaactcttaacaacacaaactcagtacaacccagaatgtgtcccacagtaggttacctggggcacagtatatataacaggagtatccgtttggcacaggtggtaagagaagcagggagagaagcaattgttgcatttttttattctgctgggtgcttggtgatgctatatataaaatagggtatgtgtgcagttgagtgggtagggagaaaggtgaggcatcttaaggcctggtggagggtgactgatttcatcctgtcttagttctgcatgtgataaggaggtttataaccaatacttgtcagtgttaaatatttaacaaactccagttacacaggtaagaggtcagcggtagcttataggcctaggttttattatcgatgtgcccaactgcagccatcatgggccactgttaaaattttcttttgaactttcatttttctgataattgcaaccagtgagaggtgaagaaaaagttcaagggaatgacctgatcttatatcatccaatacaggagatgactgatgacatggattcatacacaaacgtatatcgtatgttctccaaagagcctcaaaaatcagaagaagttttgaaaaattgtgagatcgtaaactggaaacagagactccaaatccaaggtaacgagtctgaagaaatgggcaagcagctgtgcttctcaaattgtgtcttcaactaacagcattagcatcacctgagggctcattagaaatgtaaattcacagaaactctggggactgggagaggtggagcaatctgtggtgtgacaaggactccatctgactgtggtgtaaactcaagtttgagaactactaagcactgaggtattaatcaggtgggagcagtgtaagtagagaactccatgtctgacaagattgctttcttggctttcttcccaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaaggtacaaaaacatgtgctgatcatttataattgcgattccttgtacatttttgtaattcacataaatcagttttggaatgaagagaggatgaattcattccttgggatgaataaaggttgtcaaagttcaagatccaaaactttgcaatggtgagtctttaaacaagaagagttcctgggatctctagattgggatggcacctagaaattacaggattggggatgaaagttgttgtctttctttttgttgtctacagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaataaaaaataaaaaaaataaataattggc

SEQ ID NO: 14 - DNA, 60879 bp, Homo sapiens
gggccagcggcgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtagcggccgcgggcgagtgcgggcctgcctggcatccctgcgggaaccggcgggaggccccgcgggcgccagtgcccgtggcttgggaggcggggccggcgcggcctgtgacacgtcgcactgtggggccgcggcagcctggccgggccggggcgggcggggccgggcagctgagaggcccgggcgggaggccgcagcgcgggggtcctcacgcgagccggggagcgttcccgggggcggcggcgcgggcacaccccccggcgagctcttggggcggggggcgagcaccggcggctctgagcggaggcgggggcgggggcatcctcgggggcgctgcgaggagggagctcccggctcggaaaccccggctgctggcgccggatgcggggaaagcgcggctcccccagcgccaccctggagctcgaccccgcctgttggagccggcttggctcctcgggccttgcggtgcctgcctcagtttctcttctgataaagttgccgagtagtctacgctttggcttccagcttttgtcgctttggccagggaggctcaccacagcctcctccctctcctcggttctctttggagatggaggtttcctttttttttttgtctccagaggctgttctctccctggaacttttacagctttgcgcagctggctggaggcgttggggtgacgcagggggctaaggtgacacgtcgggtcggagagggacttggagagtgcaaagggctgtcgcgtcagcgtgggctctccccgcccctcctgtgacacgagtgttgtctggttcccactgtcacttcccgaagggaacagctgttattgaacctcgatatgctggcatagaaagttcccgagtgttacaaaataggtgtttctgttggttttaagtcttgatggtacaggggagcccatattttttccagcctaggtgaggaaggaaacagtttattggaggtgatgtctgatggatgtgggaaagttaagagaaaggctccaggaattctccagtgcccgtttctttactgttctcttgattttcacatttttatttatttatttttttagagacagggtctcaccccgtcacccaggctgaagtgtagtgccttgatcctagctcactgcagccttgacctacccagcccaagccatccttccttcccagcctcctgatgaggctgacaccacagggctgtaccaccacgcccagctaattgttattattaattaattaattaattaatttttgtagagacagggtcttgctatgttgcccgtgctggtgtcaaattcctgggctcaagcagtcctcctgcctcctcctgccttggcctcccagagtgctaggattacaggcatgagccaccatgctggccttaatgttcttttttttttttttaacgttttaattttaatttttttgagacagagccttgctctgtcgcccaggctggagtgcagtggtgcgatctcagctcactgcaacctctgcctcctgggtttgagcaattctgcctcagcctcctgagtcgccaggattacaggcatccaccactacactcaagtaatttttatatttttagtagagacgaggtttcaccatgtcagtcactctggtctcaaactcctggcctcaagtgatccacccgcctcggcctcctgaagtgctgggattacaggcgtgagccaccgcgcccagccttgatttttaaatttagattgatgtgtttataaagagtgggtcctgtgtaacttagtcaagattaggatctgcggttagcaatgtgtaaactatatttttttgtcacctttatctcagaaacatcaacatgtattctctttgatttaattcaaagataattttaaattagaaatcaatgtctttatatcaagaggcttttgagagacaggcttgtattgtccaaactgctactttctaggtatgtcacccttggacaggttacttgaccactttgtcccttttttcctcctctgaaaatggggcatgaactagacctgactcagagggttattgtgaagattaaatggaataatccaagaaaaacacttagagtaggaactgcatataatagtcttcaataaatggcagctgtttttatgatgaagaacacacctgtgaaaaatttatattctgtaataagattaataaaagcaatgagcaaaaatgttttctggtaatgtttaacagtaatgtgctatatttcttggttgagaccttttatttgatcattggtttgaaacccttacctaaacgaagataacaatagcattttaaaattggggtcataaaagacagctctaagatacatgagccaggaaaggtaatcaaagaaaaacaagtcggcttacttttagaacatggtatccaatttcttcgtctcatgtatgatgatttactctagatcaaaggtcatgagggtcaattctcttttttctttttctttctttttttttttcttttgagacagtctagctctgttgtccagtctggagtgcagtggtgcgatcttggcacactgcgacctcctcctcccaggttcaagcgattctcttgcatcagcctcctgagtagctgggactacaggcgtgtgccatcacgcatggctaatttttgtatttttagtagtaatggagtttcaccatattggccaggctggtctcaaactcctgacctaaagtgatccgcctgtctcagcctcccaaagtgctgtgattacaggcgtgagccaccgcacctggccaagggtgaattttcttgtttgtggaaatccttctttgttgctataccattccttacttttatatagattgggttattcattcaacaagtattcattaagcacctatgctatgctgggcactgtgtagagcatgaaaggtatgtacactgatggtatgttcctgtcctcagggaacttatagtctagtggacagatgaagggcagatgcaggacggcaggtggtatgttttctgctctgaagcacagtgtggtggagcgggaagagtggctctgggaacagactgcatgggatccagtccccattgtgggcatttccactaaggaattactaagcagtggccacttcttatctgtcatacttaattcagtaattccttagttttctttaaaatggagatcaagatttaccgccaccatcccacgcccggaagggctcctcatgctctctgcagcatggtgcttctgtcgcttacagaacaacttgcctttgatgattttcaagagagttgtgctgtgaggtggcaaaagtatccaggcagcaggatgccagtgcctcaaggaaaaaatggtccttttcggcaatgtgttcggtactgggggcttggcccttgtgtattaccgcatacaaaagactttttccagggctttgtattaccagttggcattggagcaggtgcatagccatcccaaggcacagggagctctgggccctcttctcaacattcactgtctcaaactcaccaagcacaactttgtggacattgctgatgccaagttgaagattcctagctctggatccaagtcagagggccatctccatgtcagctcatccagaagtgcccctttcagaggtggcaccttgatgaggtcttcctagagcccaaggatggccagcagattcccttgttcaagctcagtggggagaatggtgaagaagtgaaaaaggagtagaaacgatccaaaagacccagctttcttctagtctggccttcccttatctccaccatgtgcccaccaggggtgatggcccatctgagtgacagacactcccgtaagctaattttccagccaccagtggaatgattgtatgtgctggcatatggtaattttggtataattctaacttgggcacaacgaatgctattgtcatttttaaactgaatcagaaagaaactcttattataagataatttatgtgaaagttctttgtttaagaaagcacatgataaaaggaatcagaattaagaaaacattcattgatttaaaaaacaaataaataggccgggcgcggtggctcacgcctgtaaccccagtaccttgggaggctgaggcgggtggatcacctgaggtcaggagttcaagaccagcctggccaacatgatgaagccccgtctctacaaaaatacaaaaattagctgggcatgatggcgagtgcctgtaatctcagctgttcgggaggctgaggcaggagaatcgcttgaatccaggaagcagaggttgcagtgaaccaaggtcacgccactgcactccagcctgggcaacagagagcgactccatctcacacgcacacacaaataaaataaaattaaataaataaaatggagatcaagactagctacataatttgtgaaatgtacaaaatgaaaatgcagggcccttgtttgaacagtattaagaatttcggccagacacagtggctcacacctgtaatcctagcactttgggaggccaaggtgggtggatcatctgagctcaggagttcgagaccagcctgggcaacatggtgaaaccccatctctactaaaaatacaaaaaattagccaggcgtggtgccatgtgcctgtaatcccaactactcgggaggctgagacaggagagttgcttgaacccaggaggcggaggttgcagtgaaccaagatcacgccattgcactcaagagtgggcgacagagcgagaccctatctcaaaaaaaaagaatttcaagatgaggctaggcgcggtggcgcctgtaatcccagcactttgggaggccgaggcagatgaatagcttgagctcaggagtttgacaccagcctgggcaacatggtgaaacctcatctctaccaaaaaaaaaaattaaaattagccatgcatggtggctcatgcctgtggtcccagctgctcgggaggctgaggtgggaggattgcttgagctcgggaggcagaggttgaagtgagtcgagatcatatcatatactccagcatgagaccctatctcaaaaaaaaaaaaaaagaatttcaagatgagacagcagagcattaagccaatcacacactcttttattctaagtgtggggccctctgcgactgcatagatcacacacatgcccaggaagctggccctgatggggatgatcatagtaccttctactagtaccctactaatgaaagcgttgttaggaagatgaaattggctaaagtgccaacaatagtgcctgaattaaacactcaatattagctgttattattatttgtatactaattattctcatcattaaacaaaacaaattgtcagtcaaaagctatttcttgctcatcaccataagaactgatgttctgctttaaaagccacatcttgactttggtttgggattgcatatcaaatcaaagcgcagtccctgcttccaaagcatagcctcctggtatagcaggaggatcaaggcagcatttatgggagccagacctgtatttctcaccacttctgacctccacacgtcccagtctccacttgttagctcctctacccctataaactgctccaccatgtgcattcgcatttagtgagcacctgtgttgtgccaggcatggtgccaagctcaggtgaataaggtagacatggcccccccctcatggggctacattttagcaatcccttagcttaggtgatgggtccggaggatgccaaagctgcctgcctcattaggaacctcactgctctcttcttgtagccagtctggtgaccacctcagaagtgattctcaaacttggcctgctctgggctgtgtacccaaaatctctgccatcacctctaccaaaaaccctttgcatcctgtccttgcttactaggaaacaatcttgtaactaattgtcttgcccactggactgctagactgtgggctccatgtgggcagacttcctgaaccacgctggtatgtccacttggtatgtgccaggtacacttgatggtaagtgcacagcaactggtagttgagtaactaggtgagaaattacacacagcctgacggggaagaacagcaccttttggcagagtctgtcgttttgtttgatgccccacagaagagggttctcctaatggccatcaccacagggcgtttgaatttgcgcgtctgtcttccccacttctcagtgagctctttaaagactagcaccaataagcgttcagctagtgtttgtgctgctactttttcatacctcatcacctgtcacatgtctgacatacagcaggtgatcagtaaacaccaaagtaaatctcctggcctctttttgtgtcagttgtcactccaccccgattattcagtgtgcgatcagtgtgagcatattgtggtgaggggctttagaaaacccactcgtgtttcctctcttgtattgcccttgtattgccctgaaaagaccagaagccagatcttgcttgataatgataggttggacaaccttcacataagtgattctgcctataaagtatatcttttttttttttttttttttttttttgatagcagggtctcactgttgctgaggctggagtgcagtggagtggtctccgctcattgcatcctccgcctcccaggctcaagcgatcctctcacctcaaactcctgagtagctgagactacaggcacgttccaccacgccggctaatttttttaattttttggtagagatagggtttcgccatgttgcccaggctggtctcaaactcttgagctcaagcgatctacctgccttggcctcccaaagtgctaggattacaggtgtgagccactgcacccagcctatatatctaatatgtatttttttttcctgcaaaaagattaaaaacacctctattagaggaattttttccctattcggagtttaatgagttataaatactactttccacaacaagcactgtgtattttatgggcccagcacacttccgacgcgtgactctgctagttagcactgtgtattttaaagtacttttatgctcctgttgggcttcagtgtcagtgttgaaggggctagtaatttttgagctggcaatacgtttttaaagttattcttttgagtaacaaatatttactgaatgcttaccatgggtaagcctatttttcaggctgtgtgtgagatttaaaagtacacaactattcagcaaacacttattgtgcgtttaccatgtgcaggttctgtgctagtggacaggaaagtaaggtgacaggagccggacgtggtggctcacacctgtaatcctagcattttgggaggccgagagggcccaaattgcttgagcccaggcgttcaagaccagcttaggcaacatagcaagacccccatctctacaaaagaaaaaaaaaaatctgggcacggtggcatacacttgtcctaactgcttaggaggctgaggggggtggatggctcgagctcaagagttcgagactgcagtgagctaggaccgtgccactgcactccaacctaggtgacagagccagaccttgtctctttaaaaaaaaaaaaaaaaaagccataaagcagcgagctaggaccgtgccactgcactccagcctaggtgagagccagaccttgtctccttaaaaaaaaaagaaaaaaagccataaagattagcaaaagggaaagattctacccctgtaagagctctcagtgccctcagtgggcagggaacgtagtcctcggttatgaacctgcatctaagagttatcaaagtgacctggacagagtgaggcagtggaggtagagaagggcacagcatttcataaaggaatatctctctgtattagtcatctattgctgtgtatcagatcacccccaacttggcatcataaaacaacagatagttctgagggtcaggaatttgggggtgacttagctggctgcttctgacccagggtctttcatgaggctgcagtcaagctgttggcccagggctgaggtcatctgggagcttactcacatggtggttggcaggcctcctctcctcgctggcagttggactgggggcctcaactcctcagcacttcaccctctccacagggcaacctgagtgtcctcaagacatggcacctggcttcccctagagctagtgatccaaggtggggagggagagagggggagagagaaaaagagagtgggggagacaggaaaaggccatagtgtcatttgtaacccaatctcaaaaatgacatggtcatttctgccatatacacatagacacacagatcaccttggtaaagtgagggtggtggagattacacgggatgcaaataccaggaggtgggtttcactggggccatcttggagtctggctgccacaacctcttcctctggctggggagagaagcaatatgctcaacagcctgccatctggtatagccactgccaggaaggatggtagggctggagtgtttctaggcagggctgcttccctcactagcattcctttacatgactggtaggatccctgctgatgcttcaaggataaggcatgtttgagatggtacacaaacctaaattctcttcactatgtatagtgtgcattgttaaaatatatacatgatagcccgggcgcggtggctcacgcctgtaatcccagcactttgggagtccaaggcgggtggatcacgaggtcaggagatcgagactatcctggctaacacggtgaaaccccatctctactaaatatacaaaaaattagccgggtgcggtggcgggcgcctgtagtcccagctactcaggaggctgaggcaggagaatggcatgaacctgggaggcggagcttgcagtgagacgaaatcgtgccgctgcactccagcctgggcgacagagcgagactccgtctcaaaaataaatagataaatatatatataacataatctgtaatatactgtataaatcatgtagtaaactgggcacagtggctcgtgcctgtaatcccaacactatgggaggccgaggctgccagatcacctgaggtcaggaattcgagaccagcctgtccaacatggtaaaaccccatctctactaaaagtactaaattagttgggtatagtggtgtgagcctgtagtcccagctactccggaggctgaggcaggagaatcaatggaacctggaaagcagaggttacagtgagccgagattgcaccattgcactccagcctgggtgacagagcgaaactctgtctcagaataaaaaaatacataatatagtaattaactatactaatttataattaatataattatatataataataaaagagcatgaaatttgaggcttttaaaaaaacctaggtgagatattttctaataatacaatcccaaagtttacattgtaaaggttaaacagttttcaagctaagtcatttactgtatcttacaggataatttatttggctaacataaattagtaactgaatttaacattttttttcaggtgtgttttgattgtggtgccaaaaatcccagctgggcaagcataacctatggagtgttcctttgcattgattgctcagggtcccaccggtcacttggtgttcacttgagttttattcggtaagtgaatcttctctcattggggtgagattgattacattgttacatgggtgtttttttcccttttttcttttctttttttgagacagtgtcttgccttgtcgcctgtcaccttggctgcaggagtgccatcatagctcactgggctcaagtgaactcagcctctacaaaaaataaaaaatgttgtggtgtgatgatgtataactctagtcctagttactcaggaggctgaagtgggaggatcacttaagcccaggagtcaaggctgcagtgaactatgatcttgccgctgcattccagcctgggcgacagagtaagaccctgtctcttaaaaaaaaaaaaaagaaagaaagaaatgtgattttcagtgttgccatacagtattaaaaggtgaggcctttaagaattgattgagccctcattggtatgggttaatgggttatcatgtaagcggctttataggaaaaggaggagagacctgagctagcacgctcagcgttctcactaggcgatgctgcctctggactctacagagtccaaccagtaagaaggttcttaccagatgtagccccttgaccttggtcttctcagcctccttaactgtaagaaatcaacttcttttctttataaattacccagtttcaggaattctgttacaagcaatgaaaaaccgatttatgtcaatcatcttctaataattcggcagtacaaagtacagactcatgggagaaggggaatcaggtgctgtgggtctgtcctatgtcctccaaagtggagagtttatgtcaatgatgagacactctccttgtatcagggcttcacttccaccgtaatcttatagctctggcttccaaggacactaatatcacaaagcctgagtgaatgatttttagtggcagtttcaaatgtttataacatgaaggtcttttttctccttttatctgaagacttgggctgcattggcccctctggtgagtaaaccgtcttctacttctgatactctatggcaatagcccatatggggccttttgcatcagaagaagacaccacctttggactgacagtctgatgggataaccccacagtccagtgggaggcaggactatttgtgaagtgaaataaattgaaataataaaagaaataatggaaagatccccagggcttggaagctaagcaaggcctgcctgtcacctgccacaggcccttgccaggacaacttgtgcagagcaccctcaaacagccatggcttagtcattgctgcctcccccagacaatttccagagatttccctactccatcttttctagggaaggaaccagctaggctgcccatctggaattgtggcaagcaatcttatattatgacttaaggaatatcgaaatattgatagaacgtgattattaaaaaggagcatttgtttctataagataaaatctattatgattctttgtctttttttttttttttttttttttgagatggagttttgctcttgtcgcccaagctggagtgcaatggcgcgatctcagctcactgcaacctccacctcctgggttcaagcgattctcctgcctcagcctcccaagtagctgggattacaagtgcgcgccaccacactcagctaatttttgtatatttagtagagatgggctttcaccttgttggccaggatggtcttgatctcctgaccttgtgatccacccccctcgtcctcccaaagtgttgggattacgggcgtgagccactgtgcctggccttgccttctgttttcttctaagagttttatagttttaggtcttacctttaagtctttgattcattttgaattaatttttgttcacaatgtcaggtaagagttcaacttcattcttttgtatgcggatacctagtttttccatcaccatttgttgaaaagactgtcttttccccattgaatcaaacttggggtttttttttgttgttgttgttttgggtttttttttttttttgagatggagtcttgctttgtcacccaggctggggtgcagtggcacgatcttggctcacctcaacttccgcctcccagattcaaatgattctcctgccctcagtctcctaagtagctgggattacaggcatgtgccaccacgtccatctaagttttgtacttttagtagagacagagtttcgccgtgttggccaggttggtcttgaactcctgacctcaggtgatctgcccgcctcggcctcccaaagtgctgggattaccccggctaaagcttgtttttaatgtactttgttttccagattgatcattaccagttaacttatggtaacctactctgcccagagcagatgaagactagactcaaggcaatacctagttacttctcttccttctgtctttactgtgttctttccctctttctttctgctaagtctcgcccattataacctctccttcttcctcatcgctaaagaatacttccagtttaagccattccaggaaatcgggtggttttatgatgtgttcctccgtgagggaaggagtgacctagagcctgaggggcagtacagcaggatctgtttgggccattgcaggtttaatcactgaccttttaaaagtcagataaatagaactgtatgagtcacaatgcttgtaaatgattcaaaaacagcaattaaaattcatgatacaaccttagggcaggagtctaggatttgggcaagaaaaagtcaaggatgagaaagtactcagtattgtttttgttgttatttttaaggcagagaagagctattctttaaacatttttattccttaaaaaaaactgaggggccggacatagtggttcacacctgtaatcccagcactttgggaggccaaggtggaaacatcacttgagcttgggagttttttgggttttttattttttttttttttttttcctttgagacagagtctcactctatcccctcggctggagtgcaatggcatgatctcagctcactgcaacctccgcctcccgggttcaagcaattctcctgcttcagcctccgaagtagctgggattacaggtgtgtgccaccacacccagctaatttttgtatttttactagagacggggtttcaccatgttggccaggctggtcttgaactcctgacctcatgtgatccacccacctcagcttcccaaagtgctgggtttacaggcatgagccacagcacctagccgagcatgggagtttgaggctgcagtgagctatgatctcaccacttcacttcagtctgggtgacagaacaaagaccctgactcaaaaaacaacaacaaccaccaccaaaaaaagaaacaaaaaaaaccactagctaattgggaaaaaatccaagcagccccaaaatatataaagtctctcctctagaatacttttcccctcttcttcccctcccactgccagacacacacacatgcactgcttcctgtgtggcatgggtggtgtgcatatttaactggagttttttttctttaactagaatttcaagtcaacaaatttacagaggaaaaataatttataagttatggcttttgccaagcaaaggggggaaggcagattaagagtatatggagagggcaaactgcattggttgctgactgctcccagagtggaccagattgaactgacctctgccccttttcacctccattgctgggatctccatgtttcaggctgctcctcccctctagctctgttttttctcaagtttgccgttacgtatttcatgagcttattaaaggtgaatgggatccctgcatcgatcttgttggcctggggttagggacaggcttaaatacaacgtaaataagaagatagactgcaaagttatgcatgagagatggaaactaagtcctgtgcccacttctggttggaaaataaggcaaagtttaaaagaggtaacatttgcaatgaacttggaaggtttggtgaggttttgataatggagacaaggccgggcatggtggcttgcgcctgtaatcccagcacttgggaggccggggtgggaggatagcttgagcccaggagtttaagaccaacctgggcaacatagtgagacctcatctctacgacaacaaaaaaagataatggagacaagggagggaaaattgaggtcagcactcggaccttcagatataaaagcaggaaaaagcgaaatgctttgtagcgactttttgtatgcataggaaaataaagagaagtaagggtgaaaggagaggatctgtgtcatattgtggagcgctttagctgccacactgggagctaaaagttcactcctgaggccctggaggggtgaggcatgtggggaggctgactcagcctgggcagagcaggagacagcatcaggaagaggtgaggaccgaggctgaggatgcaggagcggggatgtggttggggggtcggggggaggcaaatctgagctgtcctttcctggccttgggtgtgttccttacctctgaatgtcttgctttccttctcttgaaagtgagggtgagaatactaggacctgccgtacagggtgttggcaggagcgagcaagagagccccatacagcctggcacatagtgagccctagaacatgttgatgatgaccagggcagaatctgggctcctgctcggtggacactggggagaacctttttatgatgttggcgtagaaaggcaacgctttttatgaccttatagaggtaatcaaacaagttataaacaaagggcggctgggaaattactgagattgtctataagtaaaactctagattaataatggtatgcactttgggaggctgagatgaggggattgcttgaggccaggagttcgagactagcctggcgaacatggcaaaaccccgtctctactaaaattacgaaaattagccaggtgtggttccgcacgcctctaatcccagctacctctggaggctggggcacaagaattgcttgaatccagaaggcagagattaccatgagctgagatcgcctcactgcactctagcctgggcaacagaacgaggctgtgtctcaaaaaaaaaaaggtatggttcactgggcatggtggctcacacctgtaatcccaacactgagaggctgaggtgggaggattgcctgagcccaggagttctagaccatcttgggcaacataacaagaccctatctctatttaaaaaaaaaaaaaaaaaaaaaaggccaggcacggtggctcatgcctgtaatcacagtactttgggaggccaaggtgggtggatcacctaaggtcgggagtttgagaccaacctgaccaacatgaagaaaccctgtctctgctaaaaatacaaaaattagccgggcgtagtgacacctgcctgttatcccagctacccaggaggctgaggcaggagaatcacttgaacccaggaggcagaggttgcggtgagtcaagatcgcaccattgcactccagccggggcaactccgtctcaaaaaaaaaaaaaaaaaaaaagcccggcatggtagctaccatctacttgggaggttgagacaggaggattgcttgagcaatcctggttgaggctgcaatgagctgtgatcacaccactccattcctgggtgatggagtgagaccctgtctcaaaaaaaaaaaaaaaagaaattagtaaatataagggcagcacaaaggaaagttttggtggacctaaagcttcttttcttttctttcttccttgcccattttgtaaaaggtattctgcctatactcattctaaaatatccacattcctttacagttagtgtagggcaagctattactgaataacaacctctgctttttgctcatttctgtggattcagtataaagattctaacattgttgctttaccgtcgaccccttggggaatgtgcattgttgaggctatactcactgcctttacttgtttcagatttgatcttacagtggagagaagttaggcataaggtgtggaaggggcaggaagtgcttgtagctttcacttcaggagcatgaaatcttgtgttttttcctctctctgctggtcgtgatgttgggtaggtctcttctaccttgtgataagagaatgagcatcctccaagcttctggtagcgatcaaactggacaagtagatcaccgacctgaaaacatccaaacagtgcatctgtttcaagtagagacacattaccaaatttcaaatcatatccaaccaaggatgggaggcaaagagttggtgtcgttccagcagcccgctgacacttgtcatgtccctgtgccctgcattccaggaaggacgagaggagccaggggttgctcacgccaaccatcatccactctggagtcctagcatcccaaaagtgtgggtccttgttgacacaaacttagaattctttaggatcctaaagcctaaggaaaccttgttctcaaaagctcactgattttgctcctggggataaaaaatattaacagttagtaatattctttccatttagatctacagagttggattccaactggtcatggtttcagttgcgatgcatgcaagtcggaggaaacgctagtgcagtaagttcatctcaaactcgtcattttccttcttgtttaaatatttgttatgctataatagtaaagaagctcaggctaggtgcagtggctcatgcctgtaatctcagccatttgggaggctgaaattacaggcgtttgggaggatcactggagcccaggagttcaagaccaccctgggcaacatggcaagaccctctgtttataaaaaacaaacaagtcaggtgtggtgtctcacgcctgtaatcccaacactttgggaggctgaggcgggcggatcacttgaggtcaagagttcgagaccagcctggccaacatggtggaaccccatctctactaaaaaaaaaataataataacaaaaattagctgggtatggtggtgcacacctgtaatcccagctactcgggaggctgaggcgggagagttgcatgaacctgggaggcagaggttgcagtgagccgagatcacaccactgcactccagcctgggtgacagagcgagactccatcccaaaaaaacaaacaaacaaacaaaaagagttcaatacttgaaagtttgggaggccctatgagaagaagcagagagcctgatgggttttggagttggacagacccagttgacttgtttattcaaaaatctgttaaacacctaataaacaggaagcgttggctagctgctggggatatagtgacagacaagacaaacaagatccccagctgggcacggtggctcatgcttgtaatcctagaactttgggaggctgaggcaggcagatcgccttgagcccatgaatgtaagactgacctggacaacatgacaaaactccgtttctgcaaaaaatgcaaaaattagcaaatcatggtggtgcatacctgtagtcccagctactcgggaggctgaggtgggaggatctcttgagcctgggaggtagaggttgcagtgagctgagatcgcaccattgtgctccagcctggttgatagagtgagatcagtgatagatagagtgagttgatagattatcaaaataataaattaaaataaccaatatcccctcttataggggatattttattataaataaaaataatcaagatcccctcttatagacaggggcagtcagagagtaatcaaagaaatatgttcacaggaaaataacaggcagtgataagtgctttaagaaaattaaaacaggaagtgagggtacagagaaactggaggcttctttatgataatagttttttaataactggggtgacttttgtggttaggatggaatgcttgtatttaaattaatatttaacttcttaaatctacaaattaaaaaacccattcttttttttttttttttgagacagagtttggctctgttgcccaggctggagtgcagtggcgccatctcagctcactgcaacctccacctcccgggttcaagagattctcctgcctcagcctcctgagtagctgggactacaggtgcacgtcaccatgcctggattttttggtatttttagtagagacgaggtttcaccatgttggccgagctggtctcaaactcctgacctcaagtgatctgcctgccttggcctctcaaagtgctggaattacaggcatgagccacagcacccgaccaaaaaacccattcttcatgtctttaaatatagcaaatattgtgtgttaatttctaaacacaaacataaatactgtgtgttaagttctgtgaaaaaataaccttaaaatattcaattaatttataattttaaagaactgatttccttaaccccatttacaaacctaagtaaggattttctttttttttttttttctttttttttttttgagacggaatcttgctctgtcacccaggctggagtgcagtggcccaatctcagctctctgcaacctctgcctcccaggttcatgccattcttctgcctcagcctcccgagtagctgggactacaggcgcccgccaccacacccagctaattttttgtatttttagtagagacggggtttcaccatgttagctaggatggtctcgatcacctgaccttgtgatccgcccgcctcagcctcccagagtgctgggattacaggcatgagccaccgcgcccggcctaattaaggattttcaaacattttaaactttatttacaaattcagtatatttgattatctcaaacactgaactggcagccttacaaatctagccagccaaatcttgcacagcactggtaacctatttatcaggccaaaatggtgtagatggagtaaatggaattcctttaggcgtttcttatatgctaaagtataagaaatcaaatttgtatgcatttcaaataaaaattatggccaggcatggtggctcgtgcctggaatcccaacacttcgggaggctgaggcgagaggatcacttgagtccaggagtgtaagaccagcctgggcaacatagtgagacctcatcgtacaaaagacttaaaaattagcaaggcatagtggaacctgcctatagcctcagctactcaggaggctgaggtgggaggatcacttgagcccaggagttcaaggctgcactgagctgtgatcatgccattacactccagcctgggtgacagagcaagaccctgtctcagaaaaaaaaaaaagaaaaaaaaaatatatatatatatatgtgtgtgtgtatatatatatcaattaaatagttaaagtcagaggtctaaaatagcagtttccaaaatgctagtttctcaatcttttttcttcgttgtccctaagcataaaaatcaattaattagataattttccatttaaattggatccaatgtttccctaatgagataaattaaatactaaggaatacaattttgtcaggtagaggtgacctttggaaggccataaaccattgtaataactaagatttttttttcacttttcaagaaacaatttttgcccctcttaattaaaaatatatgcctggccaggcatggttgctcctacctgtaatcccagaactttgggaggccgaggcaggaggaccacttgagcccatgagttcaagaccagcctggacaacaaagtctacaaaaaaaaaattttaaattagccaggcatagtggtgcatgcctgtagtcctagccacttgggagtctgaggcagaagaatcacttgaatccagggggttggcgctacagtgagcagtgttcaccgtgccactgcactccagcctgggtaatcaagcaagaccgtctcaaaaaaaaaaaaaaaaaaaaaagaagtatgccttagatgtttcaaggcttttttttggtttttttttttttttttttgagatagagtctcactcctattgcctaggctggagtgcagtggcaaaatcatagctcactgcagcctcaacttcctgggctcaggtgattctctcactcagcctcccaagtagctgggactacaggcaagtaccaccacgcacaacaagttttttacatttttagtagagacagggttttgccatgttgccaggctggtctcgaactcctaggctcaagtgatctgcctacctctgccacccaaaatgctgggattgcaggcatgagccaccgggcccagccagtgtttcttattaattttttattgattttctgtttttttgtagaggcgtggtctcactttggttcccaggttggtctcgaattcctggcctcaagcaatcctcctgctttggcttcccaaagtgctaggattacaggcatgagccactgtgcccagcctcaagcatctttttagaaacctttgcccattatcatgatgttcacaaacttgttcctaaacttagcactgttggtttgacttacctgttcttatttctaagccttcccaaggttgcagagtcaccctccaaactccagaaaggagctttctcatctcaagccatcaggggttgggggacatggggagggaaggctcagatgagtggtcattcggtttagccagtggagctgtgagttctgtgcttggaaccatcctttttgtatttgaatcctaactctgtcccttgctacccatgtgacttggggcatgttgttgaacctctctgtgcttcattttccccatctgtaaagtgtagacagcagtagtgactgtctgatagtgttgctatgagggttgaatgagatgatgcccatgaagcactcacaacaggatccggaacatgtgggtgaccaatatcattatcagttaaattaggttcatcaaaggatcactcgtataggtttttagaagacctgttttaattaagatatgaattctataattcatgtctatacatggatcctcatgaagtgggtaaaagcagtttcttttaattgtttaaatacttgttttatcatcttacctatattgtagtatctgttaatgataaaatagtgctaaacaaggtaaacattaatgtagctcctcactaatttgtcaaaaattctgatttactggaatccattttgagattgattgtggacgaagtgtagtggttcacacttctaatcccagcactttgggaagccacggtgagaggattgcttgaatccaggagttggaggctgcagtgagccatgatcatgccacactaccctccagcctaggtgacagagtcagaccatctcaaaaaacaaagaaaagggccaggagcggtggctcacgcctgtaatccagcactttgtgaggccaaggcaagtggattccttgagctcaggagttcaagactagcaacataacaagaccccatctctacaaaaaatacaaaaattagccaggcgtggtggcacacacctgtagtcccagctatttgggaggctgaggtggtgggatcacttgagcccaggaggtggagtttgcagtgaaccgagatggagccactgcattgcagcctgggtaatagagcaagactctctcaaaaaaaaaaaaaaaaaaaaaagaaagaaatggattgctcgtgaattaaaagtagtcctgagtagaaagcttttccccaaataaagttcacaatgacagagatggtttaatggacaaatgaggactagttatttcattttgtaatgcaagtctcatagctagtttttgttgttgttgttgttttgagatggagtcttgctctgttgcccaggctggagtgcagtgacacgatctcagctcactgcaagctccgcctcccaggttcgccattctcctgcctcagcctcccaagtagctgggattacaggcgcccgccaccacgcctggctaattttttgtatttttagtaaaggcaaggtttcaccgtgttagccaggatggtactgatctcccgacctcgtgatctgcctgcctcggcctcccagagtgctgggattacaggcatgagccactgcgcctggccatacgtagttttacgaaaatattaatgtgcatgcttttctctgtagtcttccttttttcatcaacatgggtgttccaccaatgacaccaatgccaagtacaacagtcgtgctgctcagctctatagggagaaaatcaaatcgctcgcctctcaagcaacacggaagcatggcactgatgtaagtcactggaggctggattgtttcctttagatacatgttcacttcatagaaaaagtgatttttatcctgaatagtaaaacttttctacctgagttgtcttacaaggaattagtgtacagtagattcttactattgaagtagttatgttctgtaaattcatcatgagtactggattagtgaatactaaaacattgctcctaggagaaatacaggattaggttcctataagctctggtctcattttcatcaactgatcaatacataaccttatttaacatgtgtttctatttaaagacacctttttaaatatatattgatggctcatgaatattgaactcacagccaaggactataactcagccctgaatgaagcttatttaatgcctgaattttctccatgaggcacatcacagccttcatgtgcttcagaacattagatagcccttcagtactgcacttgagaggcatcttaaaaaatgacatcctcaataaaaagcatgggaatatgaagaacatagcacaaaataaactgcagaaaggacatttgttatgagaactgaaacaagaaggcagagtagtgtgtcttgttctacctcagctgagaatgtgcttcttgggcaactcattttttgctgcactattctccaaatgactgaaaacaccacgaggactaattttgggttaaacgtaaattttagcaagtaggtagattcataaatatggaatccatgaataacaaggattgattatcatttggaacctgcatttagatatgaagtctttgatctttccttttcagaaatggtttatgtgtttgaggtccttgacttcctcaaggtttggaagcaaaatttactggatgatagattactaaagtgcacgcagaggtcctctgtagggatgttactgattttataagaatggaaagcaccaatctttaggaaacaggtctctaagggaagtgaaaggtatcaaataaaatcctttacaggccggatgaaatgctcagccctgtgttgtttttttgttctagctgtggcttgatagttgtgtggttccacctttgtcccctccaccaaaggaggaagatttttttgcctctcacgtttctcctgaggtatgtattatgcttcacatcattttaaagtgtgcttactctgacagttaacaaaaggtgcatatttaaaatgttaggatgtaggctaagctcttgtaacaagaagtgctgaaacataactactgaagagagaaatgacattatcaacaattccaaggttaggatatctgctattgactgatggacttactttgctgttctcaacatgtggcttccatctcagggtctaaagcagctgctccagtttaagactctcccagattaagagaaaaagacaagcatccttgagagctaatgccctattcttctatttatttatttttggggggactgaatctggctctgtttcccaggctggagtgcagtggcacgatctcagctcattacaacctctgccccctgggttcaagtgattctccagcctcagcctcccgagtagctgggactacaggtgcgcaccaacacacccagctaatattttttttgagatggagtttcgctcttgtcacctagggtggagtgcaatggtgtgatcttggctcactgcaatctccgcctcctgggttcaagcgattctcttgcctcagcctcccgagtagctgggacaacaggtgcacgccaccacacctggctaatttttgtatttgtagtagagacgaggtttcaccatattggctaggctggtctcgaactcctgacctcaggtgatacccccgccttggccacccaaagttctgggattataggtgtgagccaccataccccaccacagatgccctattcttttacagaaaaagtctggagggagctcccatcccttctacttatgtcctatgagctggaatttagttgcatgtcttatctagctgctagggagaactgagaatttattactagtagtgtgccacagttcagttcagagctctgaaactgactaaaaatgaaaacatttttaataggggtttcattctcagtgccccagttttgctgtttatgtagtattatctcaaagctattggatgagttaatgcaggtaaaagtacttagtacctggcacaaagtaagccttcagtaagtgctctaaatatcactatcttcatctttgtgacctgatagcaacagtgacagcaatccatagtacttctgtggcctctcctcagatcacttagatctagggaaagtaaagcctaaaaggcgacaatatttactatttggccctttcttttctttcttcctttctttttttttttttttaaagacggagttttccctcttgtttcccaggctgtagcgcaatggcgcgatctcggctcactgcaacatccacctcccgggttcaagcgattctcctgcctcagcctcccaactagctgggattataggcatgtgccaccacacctggctaattttgtatttttagtggagacggggtttcgccatgttggtcaggcttgtctcaaactcctgacctcaggtgatccacctgcttcggcctcctaaagtgctgggattataggcatgagccaccacaccgggcctactatttagccctttaaggtaacgtgtgcctacctctgtcttggaccatcatatgttctgccagctactctagctcctcccagtcccactgggtaaggagcacgatttgttgaactcttgctcaatctattctttaattttctttttttctttcgttttttttttttttgagatggagtcttactcttctgtcacccacgttggagtgcactggcacaatcttggctcactgcagcctctgcctcccaggttcaggtgattctcctgcctcagcctcccaagtagttgggattacaggcccacaccaccacgcctggctaattttttttgtaattttagtagagacagggtttcaccatattggccagtctggtctcgaactcctgacctcaggtgatctgcctgccgcagcctcccaaaatgctgggattacagatgtgagccactgtgcccagcttattccttaattttcaatttaaaactatgtaaagttgtacacaggttgttaaagcttgttttttgggttttttttttttttttgctattataatttgcacatacttattagcattgtcacagtcaatagttaccaaaaatggttatcaagaaagaggagaacaggccaggcatgttggctcatgcctgtaatctcagcagtttgggaggccgaggtgggaggatagcttgagcccaggcgtttgagacgagcctgggcagcatagtgagactccttctctacaaaaaatttaaactttagctgggcgtggtggcacatgcctgcaatctcagctactcaggaggctgaggtggaagcactgcttgagcctgggaggtcaaggctccagtgagctgtgattgtgcttctgcactctagcctgggcaacagagcaagaccctgtttctaaaaaaaaaagaaagcaagaaaaaagtagatatgccttcctttccattaacagggactcagaatgtggctgtttaaattgttaggtttttcccgtgctttgatgtgttttttatggctgttttcttgctttgtctgctaatgacttttctcgccttgtttcaggtgagtgacacagcgtgggcatcagcaatagcagaaccatcttctttaacatcaaggcctgtggaaaccactttggaaaataatgaaggtggagtccttagaactgtcatgtaatactattctatggttcagtggcatgctatgaaactattaaaaattaagatgggccaggcacagtggctcatgcctgtaatcccagcactttgcgaggctgaggcggggggatcgcctgagcccagcagtcagagaccagcgtgggcaacatagtccccatctctatcaaaaaaaaaaaaaactgaaacctaaaaatattaaaatgtagacccttctgtctttttttttttttttttgagactaagtcttgctctgtagccgaggctggagtgcgatggtgtgatctcggctcactgcaacctccgcctcctgggttcaagcaattctcctgcctcagcctccctagaagctgggattacagacatgcaccgcacatctggctaatttttgcaacatgatttcaccatgttggccatgctgatctcgaactcctgacctcaggtgatccacccgccttggcctcccaaagtgctgggattacaggcgtgagccaccacacctggccgacccttctgtcttaacaggaagaaatattcataatagactataaagtgggggaaaaatattactgaacatggaatataataatcatttttgtaaaaaaagaaaaacataccaaaaacgttctggaaagcacatagcaaattgttaaatagagagtgaaattactgaggatttttagttctcacttgatatagtgttgaagtgtctgaacttttataatgagtatgggttacttttatcatcaaaaacaaaatttcaatttaaaaacttataaaaatagttgatacataatgattcacatttggtgactttcttacaggattacatttattgtaaatatatcagttgcttacatattaaaaatcacttgtgacatgagtagtcagctctttctgttttaaagttgtgcatcctttgttaggccagaatgttagtgtaaattaacaacaaaaatgtaactttggacaactaagcagtgagttcatgggttatgataccttaagaagtgctggcttatataaactgagccttgaactactctaaggaacatagcgtaacaggaaagatgaagcagtcaccaaccgcgggttgggtgatggtattgagaaaatttctggcaaggattttgctggagggtaggagagtaagtggtatttatcaagaaagtagtcctaggagagagaggcactcagctgtgtcccagagtggagtcatgttgtaatgaaaaggagtcgcatagccaggcaggttgtgcacgcctgtgatcccagctactagggagactgaggcaggcagatctcttaagcctatgagtttgagactgcagtgagctatgattgcaccactgcactctccagcgtgggtgacagagacccggactctaaaaaaaataagaagaaaaagaaaaggagtcgcttcctttgtattgagttataggtataagggtgggaatgtctgagatttccatcaaacagtagaatgctgatttttcattttgctggtataggcgtagacatatcagtgaatcaggataagaacattgcatatcctaggtaacaatgggttatttgatgaatggaatttggacaagtgtctggcattttagaaacaaataataaaacaaagtagaatttcttctttactctttacacaaggctaaattcaggtagttcaaagatttacatgaaaatatgattatcctagaagaaaacatgggtaaagccttttttattatcctgaattgaggaagcccttctaggcatattcaaatctcataaaaggaaaaggttaataaatctgatgacataaaaatagaacatttctgttttgaaaaaatactttaaagtgaagacaaatgataaacttatatttgcaattcatatgtagacaaaaacggcttgtttccttactatgcaaagaactctgatgtggttgttttgtggatgatttgcaccctgtgattttttttttccacattctttttttaggcatatgaccgtagatgcctgcaaagaagacatttatacacctctaactggagtttagttttttgatttcttagccttacactatactgcagccacatttgcccttgggtgtttttctgcctgtgtttgctttttgttttgcttggagtgtggctctgccttgattggcatgggttgcctctttgttggggttcagctttaagaccagccaacgagcactcccagtcacaactgcatttgtacattttttcttcctcatagcatagcaaacaccagttctggaaattactgcgtttcttagtttgcatgtccactgtgtgtcccctctgctgagctgtgagctcttccagagagagattgttttttaagatgagaaatctacctgagccattgattgatttaccgttatcaatcagagagaagagaagaaagaattcccacaatctcctaacaaacaggaacagtgcgttatatatcttttgtgaaagtacagatgataatttaactattttcactattataatttattagcataaaagggctttgaggccaggcacagtggctcacgcctataatcccaacactttggatggctgaggcgggtggatcactagaggccaggggttcaaggccagcctggccaacattgcaggaccctatctctactaaaaatacaaaaattagccaggcatggtggtgcatgcctgtaatcccagctgctcagaaggctgaggcaggagaatcccttgaacctgggaggcggaggttgcagtgagccgagttcgcaccactacactccgcctgggcaacagaacaggactctgtctcagaaaaaaaaaaaaaaaaaaaaggccgggggctttgagattgagggttagccacaggagatatgtgtaacctctgaagtccggatgtcacagtttgttttaacagaaaccccagtaactaacacagaacaagaatttttttttttttgagacagagtttcactcttgttgcccaggctggagtgcaatggtgtgatctcaggtcaccacaacctctgcatcccgggttcaagcgattctcctgtctcagcctcccaagtagctgggattacaggcatgtgccaccactcctggctaatttttatatttttagtagagacgggtttcaccatgttggccaggctggtcttgaactcttgacctcatgatgcgtcccccttggcctcccaaagtgccgggattacaggtgtgagctaccgcgcctggccctcatctttgtattttttagtagatacagggtttcaccatgttggccaggctgatcttgaactcttgacctcatgatgcgtcccccttggcctcccgaagtgctgggattacaggcgtgagccaccacacctggccctcatctttgtattttttagtagatatggggtttcaccatgttggtcaggctggtctcaaactcctgacctcaagtgatctgcccgcctcgacctcccaaagtgctgggattacaggcataagccaccacaagcccagcctacactttatctatttttaaagtaataaataaaataaaattaaaataacaaagtatggttgggcgcggtagctcacgcctgtaataccaacactttgggaggccaaggtgggaggtctcgaactcctgagctcacgcagtgtgcccaacttggcctccgaaagttctgggattacaggtgtgagccactgtgccaggcttttaatgaaggcttcatagagttgctaaccaggatcactttttaggtaaaatagaataaacaaggcagatttcttggcaactgaaaatttagatttctatcactgatgtaattggtattagaatttccacatattaggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtaagaagagtgaaattctgtctccaaaagaaaaaaaaacaaaacaaaacaaggatttccacatattaacatacattgggtatgtatagtccacagaggtagtaagtatcttttgacaggtcacattaaatcaccagatcataaggtagaattttgaatcgtattagttgaagagaccactaacatttttatttgataaagccattggattaaaaataaacttctactttaatggacttttaagtcaaaattcttataacgttaaaatagaatatacagctaaaaaggtaggtgatcattgacaaaattggataagatgtagcactgagcaagttgaattattatatattcaaaagcaagttagctgagtatattttctgcgctaatatcaatgttttgaattttcaggtggacaagagcaaggaccaagtgtggaaggtcttaatgtaccaacaaaggctactttaggtaatatgcttaaaatcctacattctgatttaaagtgtatgactcattaagaaaaaaataaatcctcttgcatttggcctgggcatctcacctgacggagtaatataatcatgaccgaatctgttaataagattttattaaacaaaagatactatatatatatgttttttattcatctctcaagcttccaacaaagatgctacattttaaccagcttgataatataaaatgcagcattgtggctgggggcagtggctcacacctgtaatcctaacgctttatgaagccgaggtggtcagatcgcttgagcccaggagttcgagaccagcttgggcaacacagcgaaaccttagctctacaaaacaacaacaacaacaacaacaacaacaaaaattacctgagtgtggtggcacacatctgtagtcccagctacttgggagactgaggcaggaggatcacttgagcctgggaggttgaggctgcagtgagccatgatcacaccactgcactctgccctgggtgacagagtgataccttgtctcaaaaaaaaaaaaaagcagcaatgtgcacatttagccaatatggctgctgatggttttgattcgtgggtttatgttgggctggctcaccttacggaaataagcagtggtcagaacatctacaccattcctttttactcaagaactcattttcttctctttctgattttattataggtgaacttaatcttaaatttttcattatcaaggaattataatttgtaattgttatatattccattgcattagttggaaagcagctgctttggtgaaaaataactaaactgttagaaatgctcctgacattttcatcatgttttagactcgtcagagtttgggagcaggttatgtgactactacaatacaaatctgaaagaaagtaatgaaaaggaaaactcccacaagcatctttttcacacttgaaatgtaatgacgttattctctactcacggctaaagattgttatcttttgctgtttctggctttatgctatcttttcctatcaaagcacattcttatctttatatgaaaaaattaagactttaattttgctgggtttcttagacataattctaaagacaatatataacctataagtaaaatgtactcagaaaatgatttttaagaaactttctctaaaagtatttttgtgcaatttagaaagtattgttattaaaataagagaatgctttatgtttcttttttttttttttttggagacagagtctcactctgtcacccaggctggagtacactggcacgatctcagctcactgcaacctctgcctcccggtgcctcctgggttcaagcgattctcgtgcctcagcctcccaagtagctgggattacaggtgtgtgccaccatgcccagcaaactttttgtatttttagtggagacggggtttcaccatattgtccaggctgttctcaaactcctgacctcaggtgatctgcccgccttggcctcccaaagtgctgggattacaggcatgagccaccatgcctggccgaggatgctttatatttattttggctaatatgataaaatctatatataagccaaggtgaaaaagcacgtcactggctgctttagttgtatacataatgcctagctaactttatttttattattgttattacttttttgagctagagtctcgctttattgcccatgctggagtgcagtgggtgcaatcacagttcactgcagcctggcccaagagattctcctacctcagcctcccaagtagctgggaccacaggcgcacgccatcacactggactaatgttttttgtttgtttgtttgtggagatggagtctccctatgttgtccaggctgcgaactttatattttcaaataagttttatgcagccgtaaaaaagaacagtcatgtcctttgcagcaacatggctggaggccattatcgtaaacaaactaatgcagaaacaaaaccaaatatcacatgttttcacttataagtgggggctaaatcttgggttcatacgaacataaagatgggaagagtagacactgaggactccaaaaggagggagggagagaggggaacaagagctgaaacacttcctgttggatactgtgctcactgtctgggtgatgggatcaagagaagcccaaacctcagcaccacgcaatatacccttgtaacaaaactgcacgtgtactccctgaatctaaaataaaaatggaaaattataatgatttttaaagtttttgggctgggcatgatagttcatacctgtaatcccagcactttagaaagccaaggcaggaggatcacttgaggccaggagttcaagaccagactgggcaacatagtgagctcccctgatgtctacaaaaaaaaaaaaaagaaagaaaaccaggcatggtggcatatgcctgtagtcccagctactagggaggctgagacgagaggatcacttgaatacaggagttcaatgctgcagtgagctctgatcacactactacactccagcctaggtaatggagtgagaccatctctaaaaaattgttagatttttaagtgttttaaagtttttgaagagtagcacttgataaaagagttgtggcatggtggctcatactcataatttcagcactttgagaggctgaggcaggagcatcacttgagcccaggagtccaagaccagtctgggcaacatagcaagacacccatctctaaaaaaaaaaaaaaaaaaaaaaaaaaatagccagatgtggtggtgcgcacctgtgatcccaactactcaggaggctgaagtggaaggctcccttgatctgggaggtaatgccactgcactcagctaaggtgacagagcgagaccctgtctcaaaaaaaaaaaaaaagttgttgtaatatattttttaaatgctcctgaagaaagtactgagaggggcaagctcaggctctatttctcttcagtgtgctgttaaaaaaaaaaatacattttctctgagtttggagactgcgtggaaatactgaggacaccattttgacaaagttctgttaatccaaaatatgcttatcaacttgagtcttctggatgagaaactaaagtggaaaatgttatcatctcttaaataataaagtgcagtatcttagaattttaaaagacacactaaaaaagaaaaattatttctattggtcttactttttaatttttattttttggcagaggtatcctctatcataaaaaagaaaccaaatcaagctaaaaaaggcgtgagtattatgtactttatatataaaaatctggtagttaagctttaaaactaaaaagccgcttcgtcattttagttttattcttttgaaccatcttgtaataaatgtagctttgatataaggagtctatgttttgttcaaagagattaatgtcaaagagattaatgttatacttattgaattttttctagaatgattatttaacattttttctgtctatgacaaaattctgaaaaaaattaacaaaggtcccctgggaatttgtctcctgcttgtgtagatcaataagcaatgacatcttgtgaggcttagagggtggttgtctggtgagttttcagatacagcgaagcattgcggagcaccagctctggaggcaggtgcagggtttgaatcctggccttgccatgtattggctgtgtgaccttggccacattccttaacttatatgagctttactttcctcagccctctgtatccaggggttctgcatccatggattcaaccaattgcagatcaaaattatttgggggggaaaaaaaaacaataggccaggcgtagtgactcacgcctgtaatcccagcactttgggaggccgaggcaggtggatcacttgagccccggagttcaagaccagcctgggcaaaatggtgaaatcccatctcttcaaaaaatacaaaaagtagccggatttggtggcccgtgcctgtagtcccagctactcgggatactaaggtgggaggatcgctttaccccaggaggcagaggttgcagtgagctgagattgtgccactgtactccagcttggtcaacagcatgagagcctgtctcaaaaaaagtaaaaaaaaataaaaagtaagaatacaacagtaaaaacaatacaaataaaaacacagaattagtaactattttcatagcatttacattatttaggcataataagtaatctagagatgattgaaagtatactggaggctacacgtgggttaaatgcagatactacgcccttttacgtaagggacttgatcatcgcagattttgttatccacagggtcgtgaaaccaattcccccatgctgagggactcctggaataatactaacttcacagagttctgaggactaagccacagaacaaatgtagagtgcttgtcacagtgcctggcaggtcctaacccttaggaaatgttagctgtagtcacagaagctttcaaacagctcgtgtagactatagtcttatatatgttctagcttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaatgtaagtttaatttcattatattaatacattttcagggaataaaactattaactcaagattttgctttccaaatgccatgtatttttgtgtggggggggaagggagggtactgcaaaattcagttttatgaaaactgatattgcattggcatgtggattggaagggaaagagacgatgggggcagcaacactctgctgaggctgtaagggcaagactggagtgacatcagtgagaagggaaagacagagatgcatggaggtgtttacacatgaaacatgcttcacattattagagttggggaaatgcaaatcaaggccacaataagataccactgtgtactctctagggaagctataataaaaaaatcagtaacaggtgttggctaggatgtggagaaatttgaacccttgtacattgctgatggcaatgtgaaatggtgccactgttgtgaaaaacagtttggcagtccttcagaaagttaaatgtaaagtttccatgtgacccagcaaatctactcctaagtatatactcaagagaaattaaaacttacatctgtgcaaccacacacaaactcgtgcatgaatgttcatagtggcgttaatcctaatagccaaaaagtagaaataagctaaatgtctaccaactgataaatgagaaagaaaatgtggtatgtccatacaatggactattactcagccacaaaaaggaatgtagtcctgatattggccacaacatggataaaccttgaaaagtttatgctaagaaagaagccagtcataaaagatcacatgatatgattctgtctatatgcaatgtccagaataggcaaatccgtagagacagaaagcaacttactggttgccagggcctggggtgaggagagaatggagagtggctgctaatggtccaggcctgctttttggactgctgaaagtgttctggagttagtggtgatgatggcacagctttgtgaatgtgctgaaaccactgaatcatgcactttaacagggtgagttttacggtatgtgaattatatctgcataatgaaaaaagtatttataatctgaagccctgttggactctgtgactaaattctaaatacatgatggaagactatggctctggtcgtgtctccagaggttctgagcctggatcttggagagggagaaggaagagtttcagagaatgaagaaggtggaatgatcgtgtgtgtcgggggcctgcctgaagtggaggagttggaacgataatgtggagcaccttaaagtcaggctgtggttgtccacttacccaagagaaacagctccttcagcagtgctgtcatgaaggggcgtctcgggagaatgagttcggtagtgatacccaggccaggaagaggggaggagactggaagccaggaggccagtgaagagatcggttttccgtagacttttgtaaggctcttgagaggttttcatttgtgttgaaatcagaagagaaagatggccttctggaaaccgtgactgtaccaaagatcaggagagaagggcggagggtgcatgctacacagaaaggaaaagtaacctggatccctattttttatgtgtgtgttttttaatggtgttttctcttactttcatgtgtattttatctgttttagcttgagttactatagactgtatgatgaagaaaataacacctattttatgaggtggttttaaggattagtttaatagcttaaatgctcattgaagtgcatcaaacagtacctggcacatagtaggtgctcagtaaatgcaactacttttcgtactgtcttactgttcatactgacggttcgctaagatggagtttataaggtaaacccaaataatttgaagttgatagttgtttctccttgtcatttaattcacagaacatagggggcagcactgaactgtatttaggtcgaatatggtttgaaatgctttgtgtacaaaaatttacgttgacttgtcacagactttaatttctcttactaagctaagtttttgaccctggcaaagggaaaggttagatttgagtgtttcgatggcttctcttggtatttgggagtaggctctgtccagattactcatgcttgaggttttcccagagcgtgtgtaaaatcgggccctgatcagcttccttcctgcaagtaagctggatggagaagctgcaggtaagctggatggagtgaagtctggttgttacttctaatattaacatgctaatcttcctgaaaacaggaagcaacaaccagacttcacttgtatctttcattaggagtgtttaatacatcacaaaaacaaagatgcagatcggaagatttatgaatttgatttgagaagccagtttggcaactttcatggccttgttcagaacaaccacaccactgtgccttaatgaccaccactgccactcaaacccgtagaaagtacaggtgttttatccttaatacatgagtgttatgttgcaagttagtttgtttaatggctgtaaataaagttatttcggctcagtaaactgtcagaacagtgttgttcttgtactgtcagagtgtgaaactaaacagcccatgcagcatcctggtctccttctagcagtttcccagcccgtcctcagaggctctctgtgtgcccacttggtaggaaggaaggaagaggcagagctgccttgagctgctccgcttgtttgatctgtgtcctgcagtcctcccttgagccagtacccgtaagcactcctgaagttctgagaaacgcggtgttctgacttcttaactgttggtgcttccagagagatgttctcgtaagcatcaaagtgcatgcttttagtgagtgacccagtccatgtcagattacctaggaaggaaaacttttccatctcttatctttctaatagaaccttttcatccccatgcatcttctccagaagaatctgttgctgtaattatatgtattcatgattttaaacagagctattgttttcctccaaaagaaaaagtagtatttatttgttaaggaataaaatagccataacctgttctgtaggaagagtaaggaaaacaaactgccatgtgaaaaccaaagaaatcttgcttgactcattaaagaaaagaaacagcaaaagcaagattactttttcctaataagaaattctgcaccgggcgcggtggctcatgcctgtaatcccaggactctttgaggcagaggcaggcagatcgcctgaggtcaggagttcgagaccagcctggccaacatggtgaaacctcgtctctactaaaaatagaaaaattagctggatatggtggcaggtgcctgtaatcccagctactcgggaggctgaggcaggagaattgcttgaacctcgtgggtggaggttgcagtgagccaagattgcaccactgcactccagcctgggcgacagagcaagactccatttcaaaaaacagaaagaaattctgttgtctttccctattactatgcagaaatttatttatattactaggaatttatacaatgcctcttttgccaggaattcatggtattttacatgtttttataaagtggatgataacttagaaatccttgtaagttagatagatcatttttcagggccctgaaatgttgtgctgtctcactaaaatatgatgcaaactgctattcttgctatataggcatagttttctttatgaaaaattaagtcattattgcatttttagaaatctgagagcaaggacaatgttttgtacacctttttacccctttggtgtcctgcttgtagcagatatttgattttaaatagaagagtggtatttgactgactagtagtgctaaagagtctattagctgatgagtcactatcccattttaaatgctctcagaagcctgattgcatagagatgtatctacaagaaattattttgtaaatggaaggatccttttacaattaagtaatagccccttagttgatctatttgtaaagtcaaatttatatatttatttatttatcttaaatcaagatagactagtgagactaacctcatgctttgttatgtaatgtggaagtgtaataaaatattaatccaagtaagaaatcttgcttttcactatcccatatggaagtgatttgggtatacattatgttattatacaataataggtaacatgaactaaacttgaacagtggtataggttgagcagcaatgagaaagtggctgtaagctcattcaaattttcttaaacgtctgttcaaaaaaggcaggtagaaaaaacaccaacttgccttcataattgttaattatggaaagaatcatgaagctaaaagtataaattacatgtttaattttgcttgctattttaatataagaacaaaggattaaagctaaattaaggagtatttggtttttctggcagtgtttcatcattacgattagcctataaggatcttgaaattcaaatgaagaaagacgaaaagatgaacattagtggcaaaaaaaatgttgactcagacagactcggcatgggatttggaaattgcagaaggtatgtgagactgctttcttggagttagaatttaaaacagtgtgtcaatcatcagtggatttttcttggactgtgttagtttcaactttagagatttttttttgttattcattaacttctctaattatttttgctttgctctggtattcagtataacatgaaaaatttcaaatttggctctttaaaagaaggaaaaaggtctggctctttacatgaagcacctaccagagaggaaaccatggacataaccaatatttgtgactgcatttggtgtagacacagtcctcacaaaattttaacatttttgaaagcttgcaccagaaaaaaaaattgttttattgcttatgtttttaacccctcgaatacatttgtctttgttcaaaacataaattaaagctttgtttattttggtgaaacaaaagtttgtgaacttactgatatatatatttttctgttttctcaagtgttatttcacattcagtgacttcagatatgcagaccatagagcaggaatcacccattatggcaaaaccaagaaaaaagtataatgatgacagtgacgattcatattttacttccagctcaaggtactgtattacaaatcatcgttgaagtgtcattttgaaaagcagtgactagtatggatttattagtttatttgcattaggagaaattacaaatcaatttacttcactgtttttaaaagctctggctggagccagagctgttctttggagtaaaaattagagaaacgtttgtaaaagaacaacgttggctaatattaaaatgtttggcaataaaatcagcaactgtgagttaaaattagaggtaggagagatgtgcttatttaaattatgaaattggagaaaactgcaaaatcctgaaggtatgtgttgtttagtccagcagtgggaatatttcacagctctttctcagggcttcagcagatttctgtgcttcagaatgccagcttcagaaaactccagttggtacaatagtgcattaaataaactctatgggtgtgtgtatttattaatgaggaagatgattgtactttgaggggaccccagagtaaagcctaggtttctctccttcagcactcactatcttattgagacaaaatgcataactctagtgtgaagctgactgtggagagcagtgcacggtcaagtggcctgccagagcaaagagaacaagtttaaacttgagtcagttcacttcgtaaggacctgctcggcccagtgagaggtctgctaaaaaggcacaaaatgaacctgtgatttcactggagagggcacagctcaggaacagaggggtaagaatatgggcccaggggccagatggcatggatttgaatcctggctttcacttacttgtcacctaggccaagttatttaacttctttgtgctatagcttcctcatctgtaaattagggaccctagtaatacctacccaatagggttgtgtgaggatcgaatgagatactgcgaatgctatagcacgtttagaatggtgcttggctcttactatgtttagctgctatatgataatatagaaactcagtttaagagatgtgattcagtctaaatgttttttgtttgtttgtttgtttatgagatagagtctcactctgtcacccaggctggagtacagtagcatgatctcggctcactgcaacctccacctcccaggttcaagcaattcttatgcctcagcctcctgagtagctgggactacaggcgtgtgccaccatacccggctaattttttgtatttttaatagagatggagtttcgccatgttggccaggctggtctcaaacccctgacttcaagtgatctgctggcctcagcctcccaaagtgctgagattacaggcatgagcctccacgcccagcctaaatgtttgattactattgttaggtagttaaactaaccacattgaggaccacctttgggttagcagttcatgaaaactgaaggtgttcctgtcggaaatgggcggtgcttactggaaggctccatcacttatgtctctgagggcattagagttgtctggcaatttataggtttgaagcgttttcatatgtataaaagatatatatgtgtgtgtgtatatatacacacccacacacatgcacttcatatatagaacagatataaatatattacctaggatctaattgtgaaattgtatattttcctatcaatgtttatagacaaggaattgtataaagaatactatccttaaaaatgtctctaagtatagctctaaattatttcaagtccagggattttaccaaaaaaaaaaaaaaaagtagtagtttagtggtgttccatggtggtattttcagagacttgggtggttttatatttttgcctatcctttgcagcctgtataatgcaccaagtttcactttactcagaagtgatacccaaatcatgccttttaaaggtatgtaaatagattttacacagagtaaaattaaatgtgtaatttgatttggaaactacatacgtgtcagatcatttcagatgtgaatattaaatggtggactaagtctgggtcagaggaaactcttggcagtacgggtctgtattagcctgtgtggcttctcacaacatctttgattatttcactgcttattagcaacttctgcagatgatagtgtaggaaggtaaagaaagtttaggctgggcatggtggctcacacttataatcccagcactttgggaagccaaggcaggaggatcactcgagcccaggaattcaggaccagactgggaaatatagtgagacctcatctttacaaaaaatttcaaaaatattagcctagcatggtggacatgcctgtagtcccagctgcttgggaggctgaggtggaggatcacttgagcctgggaggcagaggttacagtgagattagattgcaccactgcactccagcctgggcaacagagcaagaccctctctcaaaaaaaagagaaagtttcagttaaatcagtactgttgcttggtagccgggttggtaagaaagctctaagtgaggttgcctaatgggaacttcagagaccctcactggctccaggtcactgacaggcccctgtggggcctttctgccttgtaaaggcttcagggatctttcagacttccccttcttcaaaggcttaatcaaaagagttagacccagaagccactgttgctatgaaactgttacttatggtttgaaacctgggagcagatggcatatttatatagaccacacctcctggactctttccagagagaccttggtgtattgtttatcacgacctgcagattgtctaataggaacataaatgccttctctagtcctccttggcatggtgaccaccactagtagaatgaggatactattaggtactttggcaactgaggtaaaataaacatggactctgaaagcaaatatattagttcgatgaagagctcttattgctttcaaattattcattagcccattagaacttgaacattatgaattatgaaagagttctgtttctgttaaaaataagataaaacctgtccttgtttttttttattattgagttccattatttctaggatataaacagtataattatatattgagtacaagataatgaaactagaacaatttgctcagccttataaagccagcatggccttaattagaatagacaactgtctatagctctaaatcagagcaaatgtgatattagggtgctcttatcaagggattttaaggaatgttttcaagattgggtaaagacagagtgggaggggaaaaataaaagtaaaaaagcattgagagctatacaatcaaaacattagaaagccaataaaggtttggagatgaggaaggaaagtctgtgtgtttctgagcagggactagtggccgttagtcgtcccactcaccccatccttccaaaggtcagctggagtcctggctggtggtctgtcggtcctcttagtgagttgccagtcctcctactgagttgctcctgcttagcatgagcacagagagcctctcgtggatgactggaagacagagaagccgccagccagcccacgcatggactgctgcctcacaggctcatgctggtcagggggacccaagccgatggctgtctctcttctttgacttctgaatagttcagtcacttaaaagtaatctgattcctctacatttcaggataagtacattggcttataagaatgaagaatgttatttccttagagtgttgctaaatctacaaaatttagtatcacagagtcatgaagaacctggaagttccaccccaccctcaccctgcaccagtccagtgctgacccccctcttcccactccagggcagtccagcctctactacacccttccttctcctcaaggcagccatttggtcccaggtcagctccgtgagaaactctgcctttcattaatgcagcttctgaggcttctgcattcaagtcagcctcccttccataagtcagttcccaagcctcatgagggcaggagctgaatgtgtcttcttgccctttgtcttcccctagcagagtgcctgactcctcgtaggtgcttattaagtagttttaaaattcctcactgaattgatcttagttctttcatggtgccttaaaataagtccctcaaacatgtgaatatcaccttgcaggccagcacacatcccacatcttttgaaccttcctccgatgtaacttccggttccttcagtgtcctgatctctcttctctgaaaggggatcggtcatctctcttcctccaggcagagcctgggtgcagtacagatccactcatccgccatagggagagcctggtcggtttctagctgaaatccagatacactttgaacaccacgttttccttcctaaggagtagatgctagtgtcatgagatttgttcttaatgaccttcttgccagagaaggcagaagccacatttagaaattctactttctgtctattaaggatgtaatatcataccatctgctccaacagcagtttatcctctgtcccttttttgtttcgttttgttttctgccaagaaagagtaaatgtgttcttagcatttcccccacccagatcttagctcaccgaggtccctggcctctttgctcttatgggttcttgcttccctcttatattggcctttggttactggcccctctgacctcctatgatctgcatcttctgtgcaactccttatagcacggagcttggtgctcatcttatttccagtgtgcttcctgtccttactctctggagaaaacctggatgatgtctgttaaggcctctgcattctcttctgtcacccttcctttcctaagacctccctgggatctgcctctctcctctgaacttcttggactgccttaatgaggtgtgtatatctggccagactgcttttccatcctaagctatcgtgaattctggcatggcacagtccctttttttttttttttttttttttgagacagtatcccactctgtcacccaggctggagtgtagtggcatgatcatggctcactgcagtctcggcctcccaggcttaggtgagcctcccaagtagctgggactataggcgtgccaccatgccccattaattttttcttttaatccccggagatggtcaggaaacggttattttatttgtttatttattttttattttgcattttttgtagagatggggctttgccatgttgcccaggctggtctggaactcccaggctcaagcaatccacctgccttggcctcccaaagtgctgggattacaggtgtgagccaccgtgcctggctggttgatggtcactttttctcaaggttttggcacatccacctcgcctgtcagtctctcctgttccaggcagaccttgctgctcttggtcaaagatttttctctaatcacacaggaccaaaagccaacactgagtgctgctctctgagcaatgccctgctcagtgacaattggctaattaaagtgtaaactgatctgaaggccaggctctcctgggatgcttgcaaatcagatcaagtttactgcaggctccaggctgaaagactatccccagaatggtccagtgatcatgatccatagctttgtatccaactccaggaggaggttaatgagcatcatttacatcattttcattgaatgtgcttaacacggaagggattgccaacaagaagctccttgtatggagtcagttctctaggcccagcagtgttatttgtgattgcctaaccaggcggaatgagacctaaagacagtgaaatgtgtaacctgtggtagataacatttaaagatgccctgtgttgtctggataggccaagttatactaaggttataaacatcccccagatctcaagggctgaacacaatgacaattgatttctttttcacataaagtcagctaagggttcaggtggttctctagagtacctgtcctccatgtgtcatcttgattgtccagactgatggaggtttcacctacctgagactgtagcacctggaacacaatctcttccatgtagcttgggaagagaggactgggcaaggttgaacacaggtacttgaaaggccttggaaatgacacacctcgtgtctgctcctgtctcattggctagacctagttatgtgactgccattaacttcaaggaggcatcccccacatctgtggaagtgagagagcccaggacgagtgtcaacaaggacctccaaagtcactgttgtactcttgctcctacagttactttgacgagccagtggagttaaggagcagttctttctctagctgggatgacagttcagattcctattggaaaaaagagaccagcaaagatactgaaacagttctgaaaaccacaggctattcagacaggtatgaatgcaaaactgtggggttgtagtagtgaatccatgcatttctgggaaaaaattgctgataacatgatgacatgaaaacccttgtaaggggctgggcacggcggctcattcccataatcccagcactttaagaggccgaggtcaaaggatcacttgagcccaggagtacaaggctgcagtgagctatgatcacgccagtgtactctagcctggtcaacagagtaagtccccctcaaaaaggaaaaccttttgaaaccttttgtaagactagtaaatgattttgttctactatttcaggaatattgttttgattttgtttttttgttttgttttgttttatttttgagacagagtctcactctgttgcccaggctggagtgcagtggtgcaatctcagcttactgcagcctccgtctcccaggttcaagcgattctcctgcctcagcctcccgagtagctgagactaccggtgcacaccatcatgccaggctaatttttgtacttttagtagagacggttgcctcaccagccaggctggtctcaaactcctgacctcaaatgatccgcctgcctcggcctcccaaactgctgggattacaggtgtgagccaccgtgcccagcctgttttgattttaaattactgattctaaataggaagtgcacatcagaatcctctgtggaccttgaaagaaatgtgtgtgtggagtcctcttccctgaagattctgatccatgggtcaggggtggcctaggtcaggaaggtttcacctttttccccaatttttttttttttttttttttttttaagatggagtcttgctctgtcacccaggctggagtgcagtggtgcaatctcagctcactgcaagctccgcctcctgggttcacaccattctcctgcctcagcctcccgagtagctgggactacaggcgcccgccaccacgcctggctaattcttttgtatttttaatagagacggggtttcaccatgttagcaaggatggtctcgatctcctgacctcatgatccacccgtcttggcctcccacagtgctgggattacaggcgtgagccaccgcacccggccttttttcccccaattttaaggtattatttacatatagtaaaattcatctttttaaacttacagttctgacaagcacatacattcatgtaattaccaccaaaaccaagaaacagaacagttcccatcacccccaaattttccccatgccctttgtagtcccccctcccctgcccctggcccctggtcaccccaggtctgttttctggccttacaattttgcctttcccagatatcatataaatggagtcatgtagcaattggccttcctactctggtttaacttgtcttagtacacttggggaagactcattcattcttgtattcattcctcttacttgccaagtttatccattcacctgctgaagggctgtctccagtttttggtgattatgaatgaatttattttccaaccagaggacttctgagagtgcaagggggtactactaatatgttgggacaacaggtgtgacttgaaattgtcccaggtaactgggacattttataacctatacaatgtagagagagcagtgtcctatggacattccaaacaatgtattcagtgtttacccagttgatctgaaatgtgatataacatatttgaactgaaatgtgaaataacagaccccgttttaaacagaaattccttcaaattttgtatcgtttgggtatttattcttttttttttaattagaattttcaggcttttaaaaacagcctaaaatccttttacaaaatttactgctgttggcattttaaaaaataaaatgagtatgaaacacatttgcttcacctcaaattagtttaacctaatttggctgtttttaattgcagacctactgctcgccgcaagccagattatgagccagttgaaaatacagatgaggcccagaagaagtttggcaatgtcaaggccatttcatcagatatgtattttggaagacaatcccaggctgatgtaagggtccagagagtttctttgggtgccccataatgcaggaaggaagtgtgggtgtgggcattgtcggggaggagatcctgagtgagctgggctcaggctgccagatgccctctggcctgaaagtgctggagtcaggacttgaacccaggtctgtataactgatcatgtgcttgctacctcagcaagaggaatgtttacaagacaaggacttatctcacagttgtcttattcctctcttggtgttttgaatagccattatccagtatcttttgaatatatttcaattgttggtgcagctgtaatttacttaataacttttaaacatagtgaaatgaagcacatagatatgtttctttttttttttttgagacggagcctccttctgtcacccaggctggagtgcagtggcatgatttcagcttactgcaacctccgcctcccaagtttaagcgattttcctgcctcagcctcccaagtagctgggaatacggccgtgcaccactacacctggctaatttttgtatttttagtagagatgaggtttcaccatattggctaggctggtcttgaactcctgacctcaggtgatctggctgcctcggcctcccaaagtgctggtattacaggcgtgagccaccacgcccagccagatatgtttctgaggagtgcatatatttattttcaggttgttggcttttctcagaaatgttaatgaacttggccaggcactgtggctcacacctataatcctagcactttgggaggctgaggcaggtggatcacttgaggccaggagttcgagaccagcctggccaacatgatgaaactccgtctctacaaaaaatacaaaaattagctcggtatggtggtacgcgcttctagtccagctacttgggaggctgaggcagagaatcgctcgaacccagaagcagagtgagactctgtctcaaaaaaaaaaaaaagaaagaaatgttaatgaactcatcatagtgaagtcttgctaagctgtaagactcaagtggaagtggggaggtttacgtctttcctctcatcctgaattgctagtgtgcctctgactatttggatgatggtttcctaaaatgtgctgaatgtattttgcagaaatttaaacttctgcaagtgtaacatttcgccatcatttcgaaagtagaattgccccttgctgttcccacagtccataaaatctgccttgcttcaaagttgacattcaagttcagttttaaaatagtgtcatggggcttggaaaagagactcttagagtggcctttgctgacagctggctagaagcagcaccaggagagagatgccgctctccctccctcactccgacggcctccgcactggccatcgtggctgaggtgttgtatgttgatcagtctgcctgtgacctgcctcccatgcagaacatgagctttgtgctgtcccgcaggacctggccttggcagtggcattcagtaactgttggaaagaaagagcctgggggtcaaacactttcaaatgacagctcttcagtgattctttttgcaaaactgcccacaatctttggagcctaacatttccttttccttgtcttctctagtatgagaccagggcccgcctagagaggctgtcggcaagttcctccataagctcggctgatctgttcgaggagccgaggaagcagccagcaggtagggggcactgaacaagagctggtctctgtcatgtctacggtatgaacacatttcatctggataggactgtttccttttccaagatattttagcaaccattattcgatgctctgatctctgctataagtcaggtagagcagaagttactattccaggcttcacacgtaaggagaccaagtcatgaaattaaagcaacatcccatcattgcctggcaagtcatccttctgaacactgtcatagaggagtgttttctagctgagtgcggctgtgctatgaaataccatgtgctatcttagccttagaggtggacagcgccgggctcccgtgtgatcctcaccaccctctagctgtgagcccttgaggatgtcatggtgtctttagcctcagtctcctcctctgtaacgggggtggataaaaccacctcacaaggttgtcatgcggcttaaatgagcaatgtgaagtgccaccaagtgtctggcacacagcaggccccaggggtgggcagaggcagatagaaacatgtggctctaacagcatctgtcttctggggaagacagaacacagctttgggagtgagcaggtggagaggaattgcctgtctcccatatccctcttcagggttcagaccccagcgaggaggtgtctggtcctcccagggctgggatggcctaggatggggcggcctgtgagcccagtggtgggcctcagagcgccggcccctctgcttcgacttcccctccccctgactgagggatgccttgtgagagtaccctacaaaggcctctgccaggccacagtggggaggaggggccctgtggttaacgtgaaaggggcagcgtcctctgaggtcatttcaggaagccatttatcagcaggagagccaaggggagggatgactctcaggagccaggcattccaagcctggcaccctcagcatccctaggcctagaggagctggctgtggctctaagtgaccaacctaggctatcacttggccttacagccacagagaacagctgttttcagagtccaaagagaaacagctcgagagaggtctgagtgtcggacattctgggttgtggtttggggatgttatagagacacactgtggccctcggggtgcagtgggcactgccaagttgctgtgctgcagtggagggagagtcctagccaggtggcagcaagtgagacaagggttgtgttggcagagcagctggcagagagccaggcagcccaaggagccagaggccagggccagagtggacaagccccggcacatccgctgccagtgagagtgtgagggtgcctgggggtgcgcagccagggccacggctcccctgagccactctttggtcaggagcacaccctgtgcctcaccccagacttgagcagaggggcctcgtttcccttgggcagtcagttacttgctgactgggcatttcctggcagtgagtcttggtgggggcaggtgaggctcattggcttgttccatctccaaactttcagtgtcctggcctgttgtcagggcaacttccttttgtgaccacccctggcagagaggcactccggccacctttggagacctccagcagccccacaggtcagtgctgggtcgccttgtaggggccctggcacagccagcagccggtccagagacctgcattgttcagtcccctgactccctgcaatggatgcctttgtaatttaaatcaatagaagttttactctgaagcactgtttgtttttttaaaaaaatatttggagatcaaatgagagcagcctttccagttactgaacaaaaatagtggcagcctgtgtttaccttcctgttccctttcagagaacaaagatccattaaatttttttgaccctgtgtggatgccaaaccaaccctggttcctggcacctcgtggtcattgtaaggtgcaccctggggtgagaggccacccagaaactcactcccctgcccccgccggggtctaactgtgttgcccaggctggtctcaaactccgggccttgagcaaacctccctcctcagcctcccaagaagctggaattacaggcaccagcaacttttattaaatatttactttttattattcagagcatatttcaacaaagagctttgtgtgttctgcctccataaagcttgttttattttataaatttttttttcttttattttgtctttaatactttcctattgaagtaaaagcttgttttaagaaaacaagttcttaaaacttgttctgggcaaggcacggtgactcacacctgtaatcccaacactttgggaggccgaggtaggcggatcacctgaggtcgagagttcaagagcagcctggctaacatggtgaaaccccatcccttctaaaaatacaaaaattaggccagtcacagtggctcacgcctgtaatcccagtactttgggaggccgaggcgggtggatcacgaggtcaagagatcgagaccagcctggccaacatggtgaagccccatctctactaaaaatacaaaaactagcttggcgtggtggcatgtgcctgtagtcccagctactccggaggctgaggcaggagtatcgcttgaacctgggaggtgggagttgcagtgtgccgagatcacaccgctgcactccagcctggagacagagcgagactccatctcaaaaaaaaaaaaaaaaaaaaaaaattagctgggtgtggtggtgggcgcctgtaatcccaaccactcaggcggctgaggcacaagaattgcttgaacctgggacggggatgttgcagtggccgagatcgcaccattacactccagcctgggcaatagaatgagattctgtttcaaaaaaaagaaaaggaaaaaagaaactattctgcttggtggctcacccctataatccagcactttgggaggctgaggaagacgtatcgcttgagctcaggagttccagaccagcctgggcaacatggcaaaaccgtgtctctacaaaaaatacaaaaattagccaggcatggtggtgcacacctgtagtcccagctactctggaggctaaggtgggaggatgacctgagcccaggaggcagaggttacagtgatctgagatcgtgccactgcactccagcctgggtgatagagccaggccttgtatcaaaaaaaaaaaaaaaaaaaaagaggaaggagggagggaaggaaggaaggaaggaaacaatcagttctgtgttccttatcttaatttccaaatgtgaaacgcttctggtgaggtaagctgctttctgggggtgtttctagcccaggagacctgcggccgttcttacgggcactctctttcactgtagctgaaggattgagtgggaagcgcatgtaagtgcctgcagccaacctgacctggcacagcaacagtccctgtggtcacacccatgggacagggtcattagagctgggggactgccatcagctgggcactgcctcaggcaggcgtgaggcactcagacaccagatgacagagtggaggcagctgtgtgagagccaggatacaacaaaaagcttaaaacccagctgccccctcagcatgtttcctcccagaaagccaattctgattgtttgaatgagagcacgtctgcatgggagtgcagacacctgcaccccttccttgtgtgcatcgtggggtcaagtggtaggttgtttgtgaggtcccttaaccactgtctccttttctctttgctccagcccagggtctaggagtgtgacctcgaaagcactgccctcagtctgcatcaggcagtctggtttggttattgccatgtgtgcttgtcagacagtatagctgtgcagtggccccaggagttccagaccagcctggacaacatagtgggacccccatctctacaaaaaatttaaaaaataaaaaaattagctaggtgcgatggctaatgcctatagttccaattactcggaggctaaggcaggaggatcacttgaacccaaaagattgaggctgcagtcagctgtgatcacaccactgtactccagcccgggcaacagagggagtccctgtctcaaacaaacaatgcccaaacttgttcttataatcttggaaatactttttctcttcatttgtctgcatgaagcagagaaattaatacgtggtattctattaaaaattcttattttgggccaggtgtggtggctcacgcctgtaatcccagcactttgggaggccgaggcgggcagatcacgggtcaggagatcgagaccatcctggctaacatggtgaaaccacatctctactaaaaatacaaaaaattagccaggcatggtggtgggcgcctgtagtcccagcaactcgggaggctgaggcaggagaatggcgtgaacctgggaggtggagcttgcagtgagccgagatcgcaccactgcactccagcctgggcaacagagcaagactccatctcaaaaaaaaaaaaaaaattcttattttgggccaggcgcggtggctctcgcctgtaatcccagcactttgggaggctgaggcgggtggatcacaaggtcaggagattgagaccatcctggctaacacggtgaaaccccatctctactaaaaaatacaaaaaaaaaaaaattatctgggcgtggtggcgggcacctgtagtcccagctactccagaggctgaggcaggagaatggcgtgaacctgggaggcggagcttgcagtgagctaagatcgcgccactacactccagtctgggtgacacagcgagactctgtctcaaaaaaaaaaaaaaattgttattttgaggagcctgggagttgtcctggaaacttccacctcccacgtcacaccatagacccatatgatcagaatctctcctgggtgactccagacctgaaacgtggccacaacccgctgcttggtcctcctgcctccagtcttggctgctgctcacccctctcctcactcttcccacagggatctttcagaacacagtcatctgtgctgaaaatcctgccctcagcttgaagcacagctccccacccaatgcccacctccaggaccatggttcccactggcctttccagcctcatttctcgtgattcactgttgtggctcactccagctgtgttgagcctgtggagcccccagcccagaatgctcttcttccccattcccccagacagccccgcaacccgtatttaccctgggggcctggttaggcccccttgcaccactcttgtgccttacactgagggcaagaccatgcgaagaccgtctcccccagtggactgtcagttctcatttctgtgcccttggcgcctgacagcctggcagaggaagccctctgcaggtgtttgaggatgaatgggtggaggggtgatgaatgaccccaaggagcttgctgagtctgagcacctgcccaccggccaacataggctggaacacgcctccccctacctcccatgtcccatggccagtgccaggctgcaggggcgatgtgttccgcctccagcacaagccttaagagctgtgcgcatgttgccatgtttctttccctgtcatagtaggcaaggaagctggaattaagaggtggccccatgggcttggaccgcaagtgactgtgatgcacagaaccccctgcccacctgcactgggcacagcaaacatcagttgtgggtggttgttagctcagagtcacctggcctgtcctgacccatccagggcatttgccccaaccacagaccactgtgtagctcagtgtcccctctgtctcagagaggggagcagctgtcttcttcctggctgcccaagcagaaacctgggaaacatccttaatccgcctgcctctcagcctgcctaggccagtcagtcagtgtgcctcttgacacctgcctcctgaggacgctcagcccgttccctcctgatccccactgccgcctcctcatgctcaggcaccgccccatgcacctggacccctgcagccacctcccagctgtctacctgagtttgctctgtgtcccctccagatgacacaggtcacactttagtgatgttatcagttaattgtctgctttccccagtaggtggtgagctgtggaaaagcaggtctgtagctgtgtcctcagtacacactgtgggtgttctgggaaaagatagggaggagagattccctgggtcaaggacgctcttcctgagcaggtggctggaactgtcatttcctggagctcattgtgtaacctgagcacactagggctgtctttgaccatggccacccggcccctccagcctgcccaggcagccctcagaggagacacagcaccccagtcccatcactgtgttggaattacactctgtcattggtgaaggcctacaagattttagacagtcagctggaggtggagatgggaggacctgcatctgtggtgggcatgggaacagtgctgggggcaaatgcagtgtctcttccaagggacacgttgcagggtaacttgtcagttctgttttattctcagagagggacttgaccaaggctttctgtttttgtttttgagatggggtctcgctctgtcacccaggctggagtggggtggcacagtcttggctcactgcaacctccacctcccaggttcaagtgattctcctgcctcagcctcccaagtagctagggttacaggtgtgtgccaccatgcccagctaattttttgtatttttagtagagatggggtttcaccatgttggccaggctggtcttgaactcctgacctcaagtgatcctcccacctcagcctcccagagtgctgggattacaggcgtgagccactgcgtctggtgggtttctgttttgtaaggagcaggtggtgtcatgtggggcttagggagtagctgggcgtggctactcctgaggacctgcagggtttgtgttgagctcactgagcccctccagcgtcttattacaattgtgacacagaagtttatgaacccctgattgtcagctctaggagtgtggtcagacctccttgatgtgtgataaccctgatgaacttcacccagattggtagcaattatggtgatgtttacatcagggcaaccaaaacttaagcaactaacacttaacaaaactaacaactaacaaaacttagggccactaacaccggccctagcaaagagggtggaagtgtgaacttctgtacctgggaagactggcagtggagcttggcttctaagtcacagtcagacagcatcagtgatgcatctatttggctcacctccttgggggaggtaacaagcttcctccataccccaagcgagtgggaggggcagtcgtagtcacagatggctgctgctttgctttgtccctgccaataaccccagagcaagcaaatggctcttctcatttgaggatacatgaatccctgggaaggctctgattggtcaggcctgggtcatgtgcccatgcctgtggacagggtagaagggagaggtggttcctggaggaagggaggagtactgttaccaaaagagggaggaggtgatgagaaacaggccatccgtgttggcccatctgccttttgctgggtacttacctgccagggctatgttaagcaccttgaggaaatgggcccagagagagcaaggaacttctctagaggcacacagcctagaagtgacagtgccaggatttgaactcatagtggtgttaagtcccccatactacattttctgtcgtgtggattctctcatgtggatcatggcagggctgccacttcagcccgagtctccatcccactgttgggccccttgtgaggcagcaggaggggagagatccgggttctctggagccgttgagcactctgggtactgggtttgccgcagctgtggccagggcagtgatgagacagtgtctgctgtgtgtgtgcagggaactacagcctgtccagtgtgctgcccaacgcccccgacatggcgcagttcaagcagggagtgagatcggttgctggaaaactctccgtctttgctaatggagtcgtgacttcaattcaggtcagtggaatggggcagtgctcactggctatgacggtaggttcagcagtttgaaaatgagacctgcttcaatcttcaactgctggaaaattcaattatatattattggatcgatatgtttgctacactataacccagaacattatgaaaaccagaaattataattttatatttaatattttctaacggatgactctaggggaattgttagaggaattgtcatgaccattgtccagtttttttcctagattggaacagagaagtattaagaagaaaactgaaattatctgtaatgccacatcacagggataacctctgttaatattttggtatatttttagctctagatttctaaggatatttttctatacgtagattaaaaagatatacatatctatctttttaaagttaaaaagggattatattgtatagagggttttatatcttgctttttctctgtgatgctgggagcatttccttgtaatgaaaagttttcctaaaaccacattctattgagtgaaaacataagccaaggatggcgcatacttgcgcatgagagtcgaggccatctgtgacgatatgagtggctcgtttctttgcaccttcttgtttacgtcaggctattgaagaaggattgtattaatgtaaaacgctgctaaaggaagtaggactgaaaccgtgtggactctggtgcctccaaaggagattcctggtccccaggcagatgctgctctagctgcagttcaaggagggcgtggaggtgcacccattccggagagttccctcagccccaggactctggatgtagccgttttcatgctgtgaatagcacagtcttccctttcatgtggcactgaagttaaaatgcatagagctctttcatgtcccttaggtcagctaagcccacatcagtgtccaaataggtaacatccctattttatagatggtcatccccattttagagatggctcccttttatatccccattttacaggtgaaggaattgaggcacagaaggttaggtcacttctgcaagatgaccagctgaaccaaaatttcagggcttcaaacaccaaatgtgttcctttgtcttccgtttcccacttgcttcccagagggctcagcaagttgcctctggcccactgagcatcctcccgcccactttgctccctgcctcctgatcccaggactgtggccgtggatgccagaggcaggatgtgaatcctgttgggttctgaagcccacacctaccctcagccttgaagctgcagcaatggctgcttccagatgagcacaccctcggggtgcagcgtccatgtcacatgcctgacatgggctgcagtgtcaatttgggtgatgctgaatattcagggcgtgggagtcagggatcgctgctgaatggtcgtgaacttccattttggttctctcttcaggatcgctacggttcttaatactgaagtcatgatgtgtatttcctggagaaattcctctttaaatgaacaagtaaccacatctcaggcggcagtgaagtccagatagttttgcagattgttttgctactttttcatatggtatatgtttctgatttttaatatttcttttgagaaattctgagttctgatgtaggagctttcctgtgatttctgtttcacgttccttcctgtcacaccctcctttggcgtctctgtgtatatccttgctttattttcttggaacctttgatttcaacactgagggcctggagacctcggctcctcctgctcctgaaccaggaggcttcatgtgggggaggaggagaggtctccatgtgacacatgggctcagggctgccagaatcagcggatgctggatgggcctgcagaaacaacactcaccacacacacttccttcaaaagaccaaaagtgactggtgtctcgtgtgacagattgcttcatttatgtttctacatagtaaggtgactgccaaataatatttgaagtcatctgtctctttgtaaattattttatatgacctataaatttaaaaatgtttttcagtgagtgcttttaacaaacttaagcttctgccctgccaagggaattaatgttatcttgtgaaaggtgttgctgtttgaattgatgagaaatggaagatgagaactccctaagagttctcataataaatcatctcatcacaaatcaatacggtatacagagttaaagtggaatgaggtaagaagatacagctacagaaaatagttgcgtgtatgggagaacagtcattgtaattgggtagttttgttaataaatatttttaaatcttgcttttcagaaattaccgaatgtgtataaacaaataaagaaaaataatttagctgtgttttagacagcattagaatatattgttcagcacagtaaaatatatttgaaatttgataagccaaaaatgtggttttgaatgaatattttgtgaatctttcttaaaagctcaaatttgtagacttctaaatagaataaacacttgcagcagatggca

SEQ ID NO: 15 - DNA, 4208 bp, Homo sapiens
ctggaggcgcggggcggggttccggtgggcgcgcgttgaggctgcggtcatggagggagcaggagctggatccggcttccggaaggtgagggccggagggcaggggctaggcaggcgcggacgctccgtcccgacctcacgcgtgacactgtgagggccagacgccagcccccgcgccgccccctgtgcctttgaggttgggcccgttctcagactccatctccggccgggccgcgcgccccgcgccctcgtgggctggtgtctcgcagctggtaggagggggcgtggagcagccggggctgcgggaaggtggagagggtctgcagaaacaggcaggggtgggcgccgtcacggcggagtccaagccggcgaagagagaggaggagctgggccgccgccctgcgccctgagcctggggtcttttgttaaggggagatgaggccccaggacggggacagtgagatcgtccagcccgaggagccggcaggacctaccccagccgccaggcacagtggtttcccttttgtttgctccccggtgggcgccagcactgggctaggaacgcgtggtttcttcggtgctccacgttacacacacttgacagggattaaccccacctgccagtggagaaactgaggcacgggggcgttaagtgactcagcagggctagggtcagacctaggccgtctgagccaggatccgcccaggctggagggcgtgccctgctcttccctgttcctggaagtggagctctctgggggtgccatgtgcagaggaccccatcggtgcaggcagagtggtttctgaacctttctactgctctacctgaaggttggggcaccgagcttcctcgatgtcagcagggcctcgtgggcctctgtggcctgggaagggagggtctcaggcccttgtgaacccatcctggagggaggacttcagccctgtagaagcagggagaattctgtttctcctgaatcaggcccttctttatcacccaaggcagcaggcgtggggggcggggggtgtcggtgtggggaactctggtggtggagttgaagattcttgccggaattcagaaagagaaagtcactgaggcttgggccacctcactgggtggttgtgagaacaccaggttaaagtagccaaaaggccactgccggagacggggcactgggtacacaccccaggaggtcatgtgttctatcaagcccacctgacaactagaggcccaggggctctggccagagctggagttgtggtcattgcagagaatgagcgtgagaatgacggggagtggggggcccgtagccctggcgtggcgcccacgtcatggggcaaagctggctgtgtcctaggcaccctccacaaccgccccagtgctgggcctgccttccgaggccactgccgatgtacggggaagccccatggattgtcgaggcagacctggcatccgccactctctggcgtggtcttccttccaaggcctggggcagcagtgttgggggtcccggagcaggtggggagatagtgccttctctaccttttctggtgcctttctggtactgctggcagtaagcagctggaaggaccagcaggtggcactgggctcatgcgggtggtgactgggaccctggctagggaacagcaagggctcaggacgagccgggatgctggacaagccgggatgctggaccctgctgcccgctgctggggaacattcttcaccatctgcatcttagggcttcacccgtccatgctctgcttgtcacctgctggactgctctgggtgaggtgctgtgacctccctgtggccgatgctggtggcctggctggtagttcacccacctgcccttttagtggcctgtttctgggctcctgggtgcccactgcccccacccccagtcctggactctccgtgctggctcctttcccggcggctgtgggccggtgcctggcctgggccacctcactgagtctcatggctccaccagccacccagggctgccctcctgagtctcggccgccaccactgcagctgccacccaccactcctgtgttcacacacaacgcatcccaaactgatctcctgtgtcctagctccaaaatgcacttgcccacggccccccatctcctcagagcagtgccgtccttttggggtcttggcgtagactcctcccttgtccccgtcctccatccatcagaaaggcagaaaggccctggctctgcagccccctcccttccccccaccccgggcatggcagccagagtggtcctttccaacgccagtgctgctttccacaaaaacctagagaggactcccagtttcctgccatggagacacggagagctcatcatgccctgggccctcagcgtctggcccacccctcactccagcctgtggaccacgctggcgcagccccgctctgcgctcccaggacaccagcacctcctgcaggatcatgagcaccagggcaagacgggcggagctgacccagcacccagaacagagttggcacaaggaaggccctactggtggcactccctcaggccagcccacctgcagagcagccacctccagcctccagacccaacccgggctctgccttccctgcctccccacaaggagagcagagccatggccctctgccggggatgggagtgcaagattaggccggactcgacgaggcctttctccactctctccctggagccccagcagcggggcctgctcccgtgtctgcgaccactcacgccgtagggaggctcccagcccagaccctgtgcagggccctggcgccccctagtggagctgcccacgcatctgcttcagcttctgccacccgaagcactaggctggcccttgtcccctgccctgggagaggctcaggcacagagggcgtctccagccagaagtcacagccactgtcaccagaatggtcaccaccctggggggtgcgggggggagggcggggcgtggcgctgacacccccctcccttctaggagctggtgagcaggctgctgcacctgcacttcaaggatgacaagaccaaaggtgcgggtgggggtgcgggcgggaggtgggtccccgtgtctgtcctcagggaccctttcctgcaactctgcagggccaaggcctcgggagggcgggggtatgtctggagcacccagccagagcggtgggtgagggtcccgcataacctccccctgccttgcagtgagcggggacgcgctgcagctcatggtggagttgctgaaggtcttcgttgtgggtgagcccagggcccacgctccctccgggcacagcatccggaattttgcgtttttccagcgggaaaaccaagacgtgttttcccgtttcccacaagggcctaaacttgggtctcctgagcctgtttgtcaggtgctgtggcctggttctgggggctgcccgtgggtgttggggggggcaccggcccaggctgaggccctcactgggctcgggtttaagatccccccagcatcccccacctctcgcgtttctcaccgcagaagcagcagtccgcggcgtgcggcaggcccaggcagaagacgcgctccgtgtggacgtggaccagctggagaaggtgcttccgcagctggtgcgtgagcgtgggtcggggcgcaagtgggggtgcccggctggctggccctaagtgcttctcttccccacagctcctggacttctagggatctcagccgtggctgaggccacccccagaggagcccctggtccacagaagcaggccttgtgtttccagcggcctctgataagaggcagggaaggacctgaaggatttggagttgattcaaacaagatctctgggagtctccagcctgtgcagaaggggcaggactgcagtgcactgcgggccttggagtgtccagtggggacactggtgtgggaaggggcagcacctggggagtccctgcctctcctccctgggacaatagtgtgcatgccacccggggtcctacaggcaggtgctgggaaaggcctggccagcaggtagcctgtgtgtttgacaaacagcagctggcagcgctgcctcctgcccacattcctgccacccgacatcaaagctggcgtgtgacctttccagccatgcgatattccccttggaagatgcttccccaggctataaatttgttctcacaaagcaacatcaataaatcaaaactgtctctccca

SEQ ID NO: 16 - DNA, 84129 bp, Homo sapiens
tccagcgcgggggtaagggggcggggcctgggcagctgcgtgccgggagcgacccccgcaccgaagggcggatggttgtgcccggcgacggcgcccaatgagcggccaggatgttggagcgccggcggcggtccgggcgctcgctggctgagggacggcggccgccgccatgatgcttgtttgctttcaatgaaaacgaggggggcgcggaggaggaggcggcggcgtcggtggcggcggcgacggcggcgcggaggcgaaggcagcggcgggcgcagcgaggagggcgaggccgggggccgagagggcgggagggcgtagtggcggcccgtcggggcggctgaggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggtgagcgaggcaggccggaggcccggtcggggcgccgctcctctctccggccgcgcacggaccgccccccgtcggccgggctcggtcgcgggcaactttcgtttcgtgggcggcggtcccgctgctccgcaagctggcggctgttgggggccccttcgacgcgccgcgatcgcgccccgccccgggccgcgcccccgggccgagtccctgggaggggggcgttgattgacggcggcggcggcggcgcgcagaggggagagggtcggcgctgggctcccggatcccggccggtcccggctgccgtcgtcggaggaggcgagtccgtgtcccgggactcgtggccaagatgggtggcaacttttgagaagcgcctctgtgggtggcgcgctgtgtggagtgtggagcttcgcgctccgtggccacaattactgtcaagcgggaaaccaactgcttaccccctcccctaaaatgtttttaaaattcagtttaacgcagattttgagggagaggacggggtggattacaggttaaagaagcacttggcatgcaatgaggatgcttattttatagtattgcgaaggattcggagattgtactggtttctacaagcagttttctctggtaacccaaattgcatccctcctttttgtttttcagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgtaagctgatgtgttttagataatctgcttcaatttgagttcccatacttacctgttttccaggtggattgtctcattgttagtgctgaatcttcttgcctacttgtatctgggaatttaactttgaagaggaagagagtgaatatgaataactgaaaaataaaatggtgtgtagtagcactttgtattttttacaatatactagaatttactactctagaacagattagtaggctgtaggagtggacgtgggccattgatcaaaagggtttaaaggcttttttggggaattgctgttaagacatttatcacagtctttatttaatttatttattgtttttgagacaggatctcactctgtcacccaggctggagtgcagtggcacagttctcggctcactgcagccttcgcctcctgggttcaagcgatccttttgcctcaccctcctgactagctgggactaccggcagacaccaccacggctaattttttaattttttgtagagccttgctctgttgcccaggctggtctccgactccagggctcaagcgatcttccttccttggcctcccaaagtgctgcaattacaggcatgagccaacatgcctggccatcacagtgtttagaatgtgatgacttttagagtaaaatttagaataaaaattgcttaatatctttagatctgtgatctactccaggtgttttgctttaaacaaaatacatgaacagctgctaatgagaagacagacctttctaggtggaggtgacttgcccatggtactgtaatgaggagggaaaggaccgggtttgtgtgcgtgtgagagcgcatgagtgtgcgacctaatcgctagaggtttgttcttttgggaggagggagggtatgttaatggttggaagttatttcaggtcacttctcagtcgatgaacgagatgctgaacgaaatgatcaaaaaagatgatgcaattgccaggcatggtggctcaccgtgtaatcccagcgctttgggaggttgaggaaggaggatggcttgagcccaggtgtttgagaccagcaaaaccctgtctcagaaaaatataaagtaacatatataaagtctgtgataactgtcacaacgtagtgagaccttgtcttgatcactttataaaaacggtgacgaaagacagattttcttgtgagactgaagattttctctgaaagtcaatcattaggtaatttccatagtgtcttgatagtggtgatgcagcccaagcggctcctcttgaatgcctgttcaatttgtaggtattttcaggttgcttaaatgttgttggcaaagtaaaactacaattattgggaaatttcaaacttttgagcagacataaggttggtttatagaacttggtcctaactacaaatgtgtaaaggcgttgtaggaatttgcccactgtacatgtagtttaaaagtatgcattttatgccaggcgcggtgactcacgcctgtaatcccagcactttcggaggccgagatgggtggatcacctgaggtcaggagttcgaggcaagcctggccaatatgatgaaaccctgtctctactaaaaatacaaaattagccaggtgtggtggcgcatgcctgtaatcccagctattcagtaggctgaggtgggagaatggcttgaacctgggaggcagagattgcagtgagccaggatcacgccactgcacttcaccctgggcaacgagtgaaactccgtctcaaaaaaaaaaaaaaaaagtatgcattttggtgaatgcttagacattccagtacctatatttgccttcttatattctttaaatgataaacctttttcatagtgcaacagaaaaggataatatatgtaagacatattggaataaatggttaaggcagctcacagctgtattctttgggccgttaggggtgagggatcagtatgttcagcacctttagaacccattcccatatgcaaggtccactggcttgggaagctctgcttgaaagcatttattactttggaaaagtcctaataggctcagctaaaaatgtatgttttactgggaaaaccaaagacttggatatgtagatatctttatacccattactcatacagtcattttataacaaaagtgtgattaataaaacgctgtgtatgtgaaattaagaattgctgagactgggcgcggtggctcatgcctttaatcccagcactttgggaggccgaggcgggcggatcacttgaggttaggagttcgagaccagcctgaccaagatggagaaaccctgtctctactaaaaatacaaaattagccaggcgcagtggcacatgcctgtaatcccagctactcgggagactgaggcaggagaatcgcttgaacctgggaggcagagcctgcagtgagccgagagcacgccattgcactccagcctgggcaaaaagagtgaaactccatctcaaaaaaaaaaaaaaaatgctgagtaaactgtaaacatatactgtatgcatagctggggtacattagagtataatggaatgtactgtattttggtacttgaataagtaattagcgaggtggggggttatttgatccaagatgaggactcatttaggctgtctccacttcgctcttctctgtccttcacctctccttcatccatttatattttcttggtaacttcagttacacgttaaggtatgtactggccatagtgttttaacactgagaattcaaagacaaataatactccgattttgccttctcatagtgtataggcttcataggtgcacagagtgctgtgggagaacacaatagagaatgattaaacttgtggagggtgtgggggcagtttacggaaaataacactgaataggaatttgccaaactggggagagggagtcatgtcaaacagaaggaagtgtgggtgcactgaggtgtcaagtgttagggtaaggctagtgataaggtgttactggaacagtgggaatgactcgagatgagcctgcaaaggtgtgtctggtctagattttgaaggaccagccttgctaagctaaaagggaagtgtatagccttatctgacagcagaagagagagccaaaatattgttagcagaggagcaaggcgatttggaggtcactttggcatccctgtggagaatagagtggaggccctacaagtgtatatttgagatagtatggagttagtgactttgaatctgttttcttctttttttctgagatgaaggctcacttggagtgcggtggcgcgatctcggcccactgcaacctccgcctcctgggttccagccattctcctgcttcagcctcccgagtagctgggattacgggctcctgccaccacgccgactaatttttttgtatttttagtagaggcagggtttcaccatgttggccaggctggctttaaactcctgacctcaagtgatctgcccaccttggcctcccaaagtgctgggattacaggcgtgagccaccatgcctggcctggatctatttttaacttggatatggtgtcttctgagtctgtggtcccttaagggactttagggctatgcccagttgctctataatacagggtcatttaaaatcaaagtgtcagtatgttttggaagaagttaaaagcagtcaaaacaatgaaagttataaaatgttactcatgaaagttcaggtgttgagaatacttgtcttctgagttaggcttaggcaggctatagaccttaagctggaaaattcaaccctatgtccacttgaaatcaaagccaccaagcttaaaaagttaccagtatcctgatggtttgctaggatatgggttgtaaacattttgtgaaattttggggggaaggcagttttctctctagtaaattattggaattggaatagtgagactagcttaaggtctaagaagttctcatacaactgttaatttatacagtcagttctgctgtaaagcaacatacaggttcctaaaaatcactgctttgcagaatcgtgcagtagaaatgacttacaaatggggttggggtacagcactctaaagctttatcagtgacacatttaaaaaaggaacctggtaaaaatgatagaacagttttacacgttgaatggttaagaaatatatagatactgtaataaatgtggcattttctttgaaaaagccctggtttgcttgtggaaagggatgtcagaaaggttgctgctggtgagttactgtgaagtggtagaagaattacttataatcagatggaaggttgtaacacgagaagcaaataggtgtggctcttaacccataataaactgacttagctggtgggtgtttgaagtgtgtttcatgtatttctacacagttcagttcggctgggtgcaagctttctcccttcatctagtgtttatgtgacagaatagcacataaataaacaggaaatatggattgtgctcaaattgttctctaatttgtgtatcaatcacagtggaacaaattcaccttttcttttctttttttttcccccctttttctttcttttgcttttccttttccttttctttcttgacagggtctcactctgtgtcacccaggctggagtgatgatgacttgctgcagccttgacctcccaggttcacccgagcctcctgagtacctggtatcacaggtgtgtgccaccacacctggctgatttttcttatttttagtagagatgaggtctctctacgttgcccggtttggtctcacactcctgggctcaagcagtcctcctgcctcggcctcccaaagtgctaggtttataggtgtgagccactgcacctggccaaattcacgttttctttttcttttcttttcttttttttttttttgagatggagtctcactctgttgcccaggctagagtgcagtggcgctatctaggctcactgcaggctccgcctcccgggttcacgccattctccttcagcctcctgagtagctgggactacaggcacctgccatcatgcctggctaattcaaatgcacgttttcaaaacaagttttatagttgattatacttgtttaatactagttttaaatagtactataactcagtttcaaaaatacttgttgaacaatctatgtgtcaggtaacatgctacctttgtggggcttagagtcttttgtcccaagtaggtttatagtgttgtggagaaggacaaatgaaccaatagagtactcatcgggttatacagtaattaagaaagcacaaagcattttgggcatgctaaggaaggagaaagtcattctgcttggaaaacccagggagtcatctcagaggtctttaagctggattttaaaggatggatagggatttgttaggttgagtaggacagggagaaggaacagcatattgggaacaacatgggctgtggagcataagacacagggatgagagggacaggaagagtggtcagaaacagcttgtgaatagttgtagggtttttcttaaagtgttgagatttcctgtatatgatagaaatccagtgagagtttaggtggatatgggtgagcaagtggttcatgtaacatactttttcaggaggcacataatgaaaatgtagaagctggattaaaggagttagagttcatttacgtcctgtgagagctcaagtacatcagcataggggatagaaaagcacaggataccagaattagggacagactagccatgagctataaaaataggaaagagttgagtatgattcagaacttgtttagcttagagaactgttggtatgatttaacttgggaaacagaagaacagatttggacgaggaaagtagaatagtttgatttttgatcctgttaagtttgacatacctcctggatacttaggtggatatgtctaacagatatctggaccagagagcggtttggggtttgatagatttggtcattgtatagttggcattggaagttaggggattactcaggaagagtgtgtgaacaaatgtttttcacccttttgacagaggtaagatctccatttgagaatcagttaagaattatggactctgctgaagggaatgaaagtatgcatatatgcaagtgtgaaacttatggaccacaagaggagaggactaagggaaccctaaggaacagctaatattttgttttggacagcattgaaatggttgaagagacaagggcagaacaggagagagtaacgctacagatgccgagagaggtcatagtgccaagaaagaaggagttttcagtagtcatcattgtgcccaggtttagggtgggatgagatctggaaatgggttgataggatttgacaggtgggggaatgaatgcagggaaaatttttatgggaccagggcatatataagtcagatagtagattgggcggaggagcaaatgggaggttaagatgaagaaggttatagactactatttgcaaaaatttaaactagaagagaaggaaagaagggtaatagtttaaagaggagacagggtcgagagaaggtaggcacctgtgttagtcaccagctttgtttccttaagtccaaaactttggaaataaatttataatgtatattgcgtgtatgtttccaaacgttcccctgatctattggttgaaattattgcatttttatttggtgatacaaaattgttttgcctgcggaattttatgtgatttcaaaaacaataaaaaaaactctttctcattagcgatagagattatctgatgtaaaatcataatattacaattttcagccttcagttactagaagaagaagatttgtcctcattagcggtagagattatctgatgtaaactcataatattacaattttcagccttcagttactagaaggataagatttgctttcatatgccatatactaggtttgcacttatgttgtgctccattgcccaaactttggttaaatatttgatgcggttttaagtgtaaaatagtagcaaagaggaaatcattagacatggtcattttctttccaagttattgctacaaacacatagagacttaataaattagccagtggctctgtgtatccaaatacagagtattacaggtgattaggtgcattgagtggttgtatatagttttactaggcagattttgattatacggagatagatgtgttagtaatctctcctaattaaaaaccaaacagagatgaagatatgacttgactaagttaaatcaaaaattgtattgcactcagccttttgggaggcaaatatttttcttctgtaaggttatgtattgttgttaagtaaacacttcagcatcataaaacaatatttgatgaagctaactgccatgttttagaccagtagtttcctttgttaatctaaaattatgacaatgataactatagtttatagactaaagaattgtcatttggtttttagttttatggaaactatagaaactcaaagatttaggggttcatagccactgaagaaaaaaaatgatattgaatgccggtggtgcagtgggctctgctgctttacatgtgtctcatttaatcctcacaccaaaattgtgacatagataccaccaatttataagtgaggaaatttaggcattaaagatgattgtaaacccatcatttcaagccaggacttgatgcaggtctgactctagtttgtatttttctttttttttttttttttgagatggagttttcactcttgtagcccaggctggaatgcagtggagcaatctcggctcactgcaacctctgcctcctgggttcaagcgattctccagcctcagcttcccgagcagctgggattagaggtacgcgccaccatgcctggctaattttttgcatttttggtagagacggggttttgccatgttggccaggctggtctcgaactcctgacctgaagtgatgtgcctgcttcggcaccccaaagtgctgggattataggtgtgagccactgcccccggccccagtttgtattcttactgacactgtgccctacttccttttttttttttttttttttttttgagagagtctcaatctgtcatccaggctggagtgcaggggcgccatcttggcttactgtgacctctgcatcccgggttcaagcgattcccttgcctcagcctcccgagtagctgggactacaggcgtgcgccaccacacccggctaattttttgtattttagtagagacagggtttcaccatgttggtcaggatggtctcgatctcctggaccttgtgatctgcctgccttagcctcccaaagtgctgggattacaggcgtgagccactgcgcctggcccctttttcttcttaacacactctcatggtattatgacttggaatggtcttttgaggttaatttgataatataggaaaacccaattgttggcccaaatttataaccgtttacactagtagttgatcatgttgacataatagtactaagtggcagaatctttgttaatatttgtgattctctttttggttatggatcaaaaacctcccaagagtccacataagagtacttttcatgctagtcaaaaattcagttctaaagcatttcattattttggaaaaggcagtctgttatacatctgtagtcaaaaagcagtgtatagctttcaaattttctgaaacattatcagtggccttagagtaagattctggtgttgttaaaggcttcttgatgctttgtaaggtcaacattttatgaataattttcttttgtagttttaaggggaaaagactagtggatcaaaactgattgctcatacattacaacttcccaagtcattgtgtatctgaattggcagcctagagtaaatattgaatggctcaaaagaccaagattcccactagatagtagtacttagaatattatggttcattccaagagcgggggcagtaaatagattttggaaagtctggcaaaaggtaagaaaactgcaaagattcatgttggcataaatattaaggtgctgaagtgataaactaaatggtggttgcttgtctcatggtaagagaacagatttaggattgatgacttccccactgcttacctttttaatcttggtgagattttactacacaaatcatggttttgacttaataccttacattagtgggcagactttaaagagatttgcggaactgagacagtgtcactcttctcactaaattttactttgttttttaaaatagttttcattaaaatgtcatttaacatgtgataggtttattactgttaaagagttcataaatattttttaaagttctcagttctaatttgattcttactgataattgatagctataacccacatcaatgaaagttctgaggtactagttaattttttttttttttttttttttgagacgaagtcttgctctgtccccaggctggagtgcagtggcgcgatcttgactcgctgcaagctctgcctcccaggttcacgccattctcctgcctcagcctcccaagtagctgggactacaggcctctgccaccacacccagctaattttttttgtatttttagtagagacggggtttcaccgtgttagccatcctggtctccatctcctgacctcgtgatccacccacctctgcctcctaaagtactgggattacaggcggtaatagttaattttttttttttttttttttttgagacggagtctggctctgtcgcccagtctggactgcagtggcgcgatctcggctcactgcaagctccacctcccaggttcacgccattctcctgcctcagcctcccgagtagctgggactacaggcctccgccaccacacccagctaattttttttgtatttttagtagagacggggtttcactgtgtagccatcctggtctcgatctcctgacctcgtgatccgcccacctcggcctcccaaagtactgggattacaggtggtactagttaattttttttttttttttttgagacggagtctggctctgtcgcccagtctggactgcagtggcgcgatctcggctcactgcaagctccgcctcccaggtttacgccattctcctgcctcagcctcccgcgtagctgggactacaggcacccaccaccacgcccggctaattttttgtattttttagtagagacggggtttcactgtgttagccaggatagtgttgatctcctgaccttgtgatccgcctgccttggcctcccaaagtgctgggattacaggcttgagccactgagcccagccaagtactagttaatttttaagactgcaaaagggtcccgagacggtagtgttttgagatctgctgtcttagtgtattgtggagggtttgggactgtaaagtataggtgaggaggttaatttgggaaagatgatgcatctgagacataaatgaggggctcatgatcccagcaacatattatttggataatgaacagaagatcttggtcttgcaagtgatagaattcttgagaatgaggctgtggtagaatagaaagactagctttggagtcagattgtccctggttcaaatcccagctctacaattcagttactaagtgtgcaatcttgggtaaattgcataaactgtgggtctcagtttcgtcttctataagataaaggtagaatctacctcatgggttgctgtgagaattaaatcaaggtcatacaggtaaattattgcatagtagttgaaagcacaaactcgaatcagacttgggttaaaataacagttgtgtcatttagtatccctgtgacctcaggaacgttattctccggaccttctttctttatgtaaagattataatagtgtctgctcacaagagttctgagggttaaatgagataatgcatgtaaagtgctggatagacctggcaggtaatgagtgctcacagaatagttggctactatatgcctagtgcagtgcatggcagataggtgcccaacacacttttgccattacacctatctatttgatgtttgctcttattttgccgtagcgtgtcactaagatagattttttatagtttaagtttgtccccttgcttcttacctcaggctatcccagaaccagtatttttagttctcttggatattaaagtcctttctattttctctagattttgccttttaggtaatagtttttcttattcctagtaagataggcactgcttttaaggcttcttttgcactcttagaaaatgtttgcttttatactatcctggcttctccctttaaattcatataagcattacctgaatatttgccaagctctggagttataaaaatatttaagatatgtaaatggaagaagcctgtgttacagaatgtgagataaaaaaatactaaggcaggtttaatgaatacaacagtagacatgttttcgaggtttagcatagctcagagctggaaacagtaaacttctgtgtttgggagggatatggaggaaggttgtaatgcatgttttaaagttgaatgtctgagttggcatttgaaggatgactaggggccttttggtgtctggggcgtttcaggcagaagacatggcattgctaaggcatgaaggtttgtgaggggtaagtgggaattagggagatccaagatgatactaaggaggtatacagagatcaagtcaaactcaacttacttgttttgtaaatgagcctgggtttcctgtttccaagggtattgagatgaacaagatatagttttaggggcccggtgtggtggctcacgcctgtaatcccaacacattgggaggcccaggcgggcagatcacctaaggtcaggagttcgagactagcctggccaacctggtgaaaccccgtctctactaaaaatacaaaaaaattagccaggcgtggtggtgggtgcctgtaatcccagctactctggaggctgagttaggagaatcacttgaactcgggaggcagaggttgcagtgaaccgtggtcacgccattgcactccagcctgggggacaagagcgagactccgttttaaaaacaaaaaaagatacagttttaggaacatgatgtacttgtatttctaggactgtcactttggacggtatatttagtacattcttgcactgctataaagaaatgtgtgagattaggtaatttatgaagaaaaggggtttaattggctcttggttccacaggctgtgcaggaaacgtggctggggaggcctcaggaaacttaaaaccatggaggaaggtgaaggggaagcaggtagtcttcacgtggccagagctggaagaagttggggtggagatgctacacacttttaaacaaccagatcttgcgataactcactttctgagacagcaccgaaggggaaaagccacccctgtaatccagtcacctcccactaggccccacctccagcactggggatacaatttgacatgacatttgggtgggaacacagacccagaccatatcagaccgtatctaggatggattagagatggggagagtggtggaggaaagactatgggtgtgagactgttggaatagctcaggtaagagctgagggaattaaggcagagtgggtgagagatttaggaagtaaaatgggctagagttggagactggatatgaagactgtgactaggtaaggaagggtcaaggatatgctcatatttttggtttggaaatctgggtgtaagcataggagaaagggcaggattgaagaccaagatgataatttgtttttttagtatgagacggagtctcgctctctcacccaggctggagtgcagtgacgcaatcttggctcactgcaacttctgctacctgggctcaagcgattcacctgcctcagcctcctgggtggctgggactacaggcgcacgccaccatgcccagctaatttttgtatttttattagagacggggtttcaccgtgttggccaggatggtctcgatctcctgaccttgtaatccacctgcctcagcctcccaaagtgctgggattacaggtgtgagctaccacgcccagcctagtaaagttttttattttatgtttttattttttcaaggcaaggtctcacggtcacccaggctagagcacaggtgccatcatggctcactgcaacctcaatctctagagctcaagcaatccttccacctcattctcccaggtagctgggactgcaggtgtgtgccaacatgcccagctaatgtatcttattttaattaattaattaattttattattattattatttttttttgagagggagtctcactctcgcccaggctggagtgcagtggcgtgatcctggctcgctgcaactctcacctcccgggttcaagcagttctcctgcctcagcctcccgagtagctgagactataggcaagtaccaccatgctcagctaatttttgtatttttagtagagacaggtttcaccatattgatcaggctggtctcaaactcctgacctcgtgatccacctgcattggcctcccaaagtactgtgattacaggtgtgagccacagcgcccggcctattttattttatttttatttttttattttgagacaaggtctggttctgtcacccagactggaatgcagtggtgcgatcttggctcactgcaacctccgcctcctgggctcaagccgtcctcccgcctcaggctcccaagtagctggaactacaggggcatgccaccacacttggttaattttggtatttttttttctacagaccaggttttgccatgttactggtcttgaactcctgggctcaaatgatctgccagccttggcttcccaaagtgctgggattacagttgtgagccactacacccggccctgattttttttgtttttgcttttgtctttttgagatggagttttgctcttgttgcccaggctagagtgcaatggcggattctcgtctcattgcaacctctgcctccgggttcaagtagttgagattacaggcatgcgccaccacacctggctaattttttttttttttttgtatttagtagagatggggtttcttcatgttggtgtaactcctgacctcaggtgatccacttgcctcggcctcccaaggtgccgggattacaggcgtgagccaccacacccagcctaattttttatttttacgtagagacaggatctccctatgctgcccagtctggaactcctgggctgaagtgatcctcctaccgtggcctagtaagacctttttgataccttggtgttttttttttttttttttcactagctactctttgttaaattcctcctatgcaattcatatggtttgctttgggagattatcacggggttctgataccaagatacctgccatagtatcatcagcaatttatagtagtctcaaaatgtgtagttatgatttaagttttgcctgttagtcaagagtagttatcttttgcagaagctttttgttgttgctgttttttgtttgatttcctacaaggaaagactaatgatagacatttgccactaaggacagctcctaaatgaggtttatcgtctgtaaacctttttttttttttttttttttttttttttttttttaagagatggtgtttttctgtgttgcccaggctggagtgcagtggctattcacaggtgcaatgatagcacgctatagcctcaaactcctgggctcagcctatcctcctacctcagccttccgagtagccaggacttctatccgtaaacttttaactggccaatatgtgaaggaaacctgactagaaagagaaacaaacaaatgtgatgacattgggaggcagcagattttgggtttgaagtgagagtagaagtgccttaactgaattgaggctgcgagaaaggcttgtgactatcgtctaatggaactaagtgggtttgtttatactagaggcacaggcacatatttttaatttgtagaattcaaatcatacacttggcaaaacagcaggcgaatatattaaagaatgtggtaggcctgccatctcagtcataattgtaatttgaaattccagagtatgtgtatttaaaaatagcatttattaaattattgtctttatatgacatttaaatgttcattatctaaaagttttaatatacctataaatgaattgtcatttagattgtattcaaagagggactgatttttgggtgagtgtcttttggggctttttgttttgtaataatggaaaatagcacagttacttttttttttgcgacagagtctcgctctcgtcacccaggctggaatgcagtggtgccatctcagcttactgcaatctccatctcccgggttcaagctattctcttgcctcagccttctgagtagctgggactacaggcacctgccaccattcccggctaatttttatacttttagtagagatggggttttgccatgttggccaggctagtctcgaactcctgacctcaggtaatctgcctgcctcggcctcccaaagtgttgggattacaggtgtgagccaccgtgtccagacaggcaggttttttttggcatatgtttgtaatttgatttcctttctttggataattccttttccatttttaaatataattaaattttttggagggcaggcacagtggctcgcgcctgtaatcccaccactttgggaggccagggtggggaaatcgcttgaatccaggagttggagaccagcctgggcaacatggtgaaaccttgtctctacaaaatacaaaaaaaaggccaggggcggtggctcacgcctgtaatcccagcactttgggaggctgaggcgggtggatcacgaggtcaggagatcgagaccatcctggctaacacagtgaaaccccatctctactaaaaatataaaatattagccgggtgtggtggcatgcacctgtagttccagctactcgggaggctgagacaggagaatcacttgaacccgggaggcagaggttgcagtgagccgagatcacaccactgcattccaggctgagtgacagagcaagactttgtctcaaaaaaaaagctgggtgtggtggcctgcacctgtagttcagctacttgggaggctgagatgggaggaccgcttgagcctggggaggttgaggctgcagtgagccatgattgtgctactacactccagcctgggcaacagagtgagaccctgtatctgaaaaaaaaaataattttaaaaataaaaaatttttttgagcgacaggttctctctctgttgcccaggctggccttgaactcctgggctcaagcaatcctcccacctcagcctgctgagtaactaggattaccggcatatgccactgctcctggctccatttttaacatatcactgttttccttcttccctttccatcaaaagcatggcttggaactcatttctcttaatctgttttgaaatttgtagtttcattcagctgtcttctcttgtaatgtgtgaaaattatgaactgcaataaagacaggatctttggaaagatgagttgtattgtattttagtctacttgtgaaagctgtggatttcagaatggtctttgaagaatactcagcaaaacttcattattgttttgtttagtcttgctttgtgtaaggcattcatggttctggttttgtgagaaaacagcttgtgagcagacccactgtggaggctaggtgggaaggaggtgggtaacatttaacttaaccttgaattatagatagaatttcagtgtgaaaatggtatcactaaatgcttggagatagggaagagtggagcgtatctgaaggatggcagtttgtctgccagttgcatcaaaagatatagaaggaaatattgggacagaagtctggaaaggtggaatattttgaattctcaactgcggagtttgaattcttctcagcagtagagatcttaaaggggaagagaagggatgatatagaatcatcattttaagtgggtataggaccagaaatcattacagctaaacattcaaattttattactatttttattcttatttatttatttttgagacagagtcttgctctgttgccaggctggagcgcagtggcgcaatgtctgctcactgcagcctccacctcccaggttcaagcaattctcctgcctcagcctcccgagtagctgggattacaggcatgcaccaccatgcccggctaatttttgtattttttagtagagacagggtttctccatattggtcaggctagtcttgaactcctgacctcaggtgacccgcctgccttggcctcccaaagtgctgggattacaggcataagccactgcacccagccatttatttatttatttaagatggagtcttgctctgtcgcccaggctggagtgcagtggtgcgatctcggctcactgcaagctccgcctcctgggttcacgccattcttctgtctcagcctcccgagtagctgggactacaggtgcccgccaccaatgcccggataatttttttgtgtttttagtagacacggcatttcaccttgttagccaggatggtctggaactcctgacctcgtgatccacccgccttggcctcccaaaatcctgggattacaggcttgagccactgcacccggccatttatttattttttgagacaggatctctgtcgctcagactggagtgcagtggcacaatcaaggctcactgcagcctccacctcccagtctccagcgattttccctcttcagcctcctgagtagctgggaccataggcgtgtgccaccacacctgactgattttttttatttttattttttattattattttgagacagagtcttgctctgtcgcccagcctggagtctggcacaatctcactcattgcaacctccgcctcccaggttcaagcgattctcctgcctcagcttccctactcttagagtagctgggatacagtcgcgtgccaccaggcccagctaatttttgtatttttagtagagacagggtttcaccatattggccaggctggtcttgaactcctgacctcgtgatctacccgcctccgcctcccaaagtgctgggattacaggtatgagctaccatgcctggcccttttatttatttatttatttatttatttttatttatttatttatttttgagatggagtcgtgctctgctgcccagggtggagtgcagtggcgcgatctcagctcactgcaagctccgcctcctgggttcacgccattctcctgcctcagcctctccgagtagctgggactacaggcgcccgccaccacgcccggctaattttttgtatttttggtagagacggggtttcaccgtgttagccagatggtctcgatctcctgacctcatgatctgccctcctcggcctcccaaagtgctgggattacaggcgtgagccaccgggcccagcccatttttattttttgtagagataggggtttccctatgttgcccaggctggtttcgaaatcaaatggtcctcctgcctcggcctccaaatgtgctgggattacaggtttgagccacaccatatggctgaaacttctcgattttatagtcagaagtcagcttcaccgtaatcccagcactttgggaggccgaggcgggtggatcatgaggtcaggagttcgagatcagcctggccaacatggtgaaaccccgtctctactaaaaatacaaaaatcagccacatgtgttggggggcgcctgtaatcccatctactcgggaggctgaggcaggagaattgcttgaagctggaaggcagaggttgcggtgagccgagatagcgccactgcactccagcctaggcgaaagagcgaaactccatcttcttcaagtctgcttcacaaagagcttgttttactgaattttgcagtgtaattaggacttggctttaggaagaataatctaagtggtatttaggttagttgtaatcctaaaagcataagtaccaattagaagaggccattgtaatggctgaggaaatgagaattaaagtcctaaattagagtggtggtagcaaaaataagagagttgtagtgtgagtgcatggttttgaggtttttgtttgctttccagttgcttaagctgtaagatcatgcatttcttatttattctttattcatcgtgcctggcagagtgcttgtcacattgaaggtactcagtaaatatttgttgaataaatgattctgtaaagaaaacttccttaagaaagcatgattccactgtactgaattgcttttggattttttttctatgaaaacctgattttggttgtgaagaaaaaaatagaccagttcattagcgtaatttgctaggcattacacaagacattgggagatacaaactgtttagaggtgatatatgctgtggtaaacgtatggtgtgcatgcagagtggggagtactgaacttgtttccgtgttgaggagggcttacagaggctgtaacatgtcgtctgagttcctgtgaagagaaagtaggagtttaggatgaaggttgtctttgataaagagattagcatgtattgaaagacttatattttaggctggatgcagtggctcacgtctgtaaacccagcacttcgggaggtcgaggcaggaggatcccttgaggccaggagttcaagaccagcctgggcaacatagtgatgcctcccatctctacaaaaaaaaaaagaaagaaaaaaacagaaaatattagctgggtgtggtggtgcctgagcccaggagcctatgattgcaccactgcactctagcttaggtgacagcgagacattgtctcaaagtcttagaactaggtttcctctaattaggacattgtagggtagcatgtgtcaaagggctggagataagtgagaaaatagttagctaagttgaggtagtagaggactttgaggtttggactttaggcaggcaggcagggccatctaaagttttaataggagagtggcatgagcaggtgcatatgaggaaggtaatcgatggcagtgtggggaggatgtgtaatagttgaagttgagaaatgaggagggtctgtattaacttcagtggaagtagattggcatgaaagttagtgtcactgccttttcatatgcgccctaacttacagtagctctaaggagcctgattactaaaaaaaaagggggtctttctgcacgtgagtttatttcttcctccttacctcccttcctttcctctgttgctctttgttttctcctttatggttgggaaaagaagtaaagcacaaagaatggagaagaagaaaatgtgaaaagcatagtaaaaggagagagagatgtcaaattcaagattaaaaaaaaaaattttctttttgagatcagggtctcaccgcgttacccaggctggtggagtgcagtggcttgatctcatctcactgcaacttccacttcctggtctcaagccattctcccacctcagcctctcaagtagctgggactacaggcacacaccaccacgcctggctaatttttgtgtagacaggatcttccatgttgcccaggttggtcttgaactcttgggctcaagtgattggcctgcccaggcctcccaaagagctgggaaaattcaggatttttttttttttttttgagacggagacttgctcagtcaccaggctggagtgcagtggcgccaccttggctcactgaaacctccgcctcccaggttcaatcgattctcctgcctcagcctccgagtagctgggactacaggcacatgccaccacacccggctaatttttgtatttttaatagagatggggtttcaccatgtgttggccaggatggtctcgatctcccaaccttgtgatccgcctgccttggcctcccaaaatgctgggattacagacgtgagccaccgcgcccagctccaaagtgctgggaaaattcaggatattatcttgtcagttaagattgcctgtaactcagtctcatttcccttgaagaaaatctggcccactaaaataaatagttaaacgtctgagaggcttttaacaaaaaaccacatttttatacctggtcagagtaacatcacgcaaatcactaatgtaaacatgaactaggtgttaaatgtcttctctcattgtccataaaattttttttattgctgatttgtggatccaacatagggatcattcattgcatctgattatattccttaattctcttcaaatctagaatagtgctgacaccagtttgttgaaggcaacaggccagtttacttgcagaaaatcccacattctcattttatctgattgctcctttggtgtcatttggccagttcctctagttttcaaatcaaggtgtaaacattactgacgtgtgtttcatactgcaccacatcaagagaccccaatatctggttcttcctccatagtattggtaagattggtgaagggggtaacaatttattcctccattaaacgttttctaccttatgatcagaaagtaatctatgtagaatctgtgtagtggtggcttttagcatttcattaatgccaatattcatctaatgcttttaacccagtataatcctttttgttttttctaagggtttcactcctttcgctcaggctggagcgcaatggcgtgatcactgcccactgtagccccgactttcctggctcaggtgattctcccatctcagcctcccaagtagctgggatgtaccaccatgcccagctaaattttgtatttttagtacagactgggttttgccatgtttcccaggctgatcttgaattcgtgggctcaagctatctgctcacctcagcctcctgcagtgctgggattacaggcatgagccactgtacccggccgtttttataatccttgaataatgtcgaatgggaattataaaatgatgttgcttgaaaaaaattctttcatacttaatttattagctatcattgttttgtaaagtagggctttttttttcttttttcttctttttttgagacagtctctctcttttgccaggctggagtgcagtggcgcgatcttggctcactgcaacctctgcctcccgggttcaagcgattcccctgcctcagcctcctgagtagctgggactacagacgcctgccacaaagcccagctagtttttgtatttttagtggagatggggtttcaccatgttggctaggctggtttcaatttcttgacctcgtgatccgcccgcctcggcctcccagagtgctgggattacaggcgtgagctactgcgcctggccgagtagaccttttcttaaacgagggctgtttgattacactgaatccagttgctgctgaggtgtaaccacttaaatctttctttttagttacgtgtctccatattgtaatagctgcttcagatagtgactgacttgcagtccatatgctgtctcttcccccatctccccctctctcctcgtcttgattactatagtagtttcgtcttttacatcattgccagctctttttttgcagcacagaaaggattatgttatctctcttttgttttggcttgattttttgaggttctcatagatttgtattgattcagtgtgtttcatttcattgtgattatgattcttactgctcaaatggtcatagtttgtcctgtgaggaccccttctagctggcttctgtatcatgttgacatgatgactccattagacttagctttttggcactgaaagatgtcccaggctcattttatacatttcctgcccatcttttgattggccattttacaaagaactttgctttcttggtattagagcttgaaattgagagtttaggagtgccattattccggagataatattacttctgcaacacttcagtagatagaaataaattaaatcacaagtctatattgatattctcaagccagttttagtatttgtgtgtgtgggggggaggagggagttgatgggggaagggagagacaaggtctcactctgtcacccaggctggagtgcagtggtgtgattgtagctcactgtagccttgacctcccaggctcaggtagtcctgagcctcaggtggcatgtgccaccacacctgggtgatttctttttagtttttgtagagatgagggaactccctttgttgcccaggctggtctcgaacttctgagcttgagcaggcctcctgccttggcctcccaaagtgctgggattactggtatgagcctggccagtgtttccgtttaatttccttgatttataaacgcgctctttctctgaaaatcttggttccttttaatttaacttaatttagttgtttaaaacattttcttgtagagacgagttcttgccatgttgcccaggctggtttcgaactcctgggctcaagtgatctgcctaccttggcctacaaagttctgggattacaggcgtgagccatattgtccaggttgtcttgggttcctaagatgaagctaaaatgagctactgagagaccaactttccagagtttattcaggaatagcagggaattgtaatcagggacacgtgtgctgtaaggaatcgtaggtgcatccagagaggttggggtaagaggaaacttttaaagacaaagaggaagtccaagtaagttgttttgaaacaaagactgttggttacaagggcttattgcaggagttgatgttggttcattggtagagaaagctgtgtcaggcaattgtgcaagcaggttatctgggacactgccattttgaggaattccttgcatagtgaggtctccatttggttagagcttgacattagtcactccattttgatactgataacttttgcattaatgtcattaacaatgtgataatgagtacttatttagcaaaagttcgtgggctgtatgtttccttagtaattgctcatctggaaaaagtcctttcatctggccaagtgttagaatatagaatattttttagttcaggtaaaatttacataaaatgcaatgtacatgtacaccttaaatgtataatttgagtcttgataaatatgtatatccatataaaccatacaccaattaatatattgaatatttccatcactataggggcaaaatgttctgatttttatcgccacaaatacatataaatggaatctcttgggtctcttatttaatgtttgagattcattcatatttgtgtgtatcagttaatcgattcttttttttttttattgttcagtagtatttagtggtgtcaatatgttaaaatttggttatccatttgctttttttttttttttccctgaaaaggaatctcgctctattgcctagctggagtacagtggctcaatctctgctcaccacaacctctgcctcctggattcaagggattctcctgccttagccccttgagtagctggaattataggcatgtgccaccacatccagctaatttttgtatttttggtagagacaaggtttcaccatgttggccaggctggtcttgaactcctgacctcaagtgatctgcctgcctctgcctgccaacgtgctgggattataggtgtgagccaccgcatccagcctatccatatactattaatgaacatttagattttcagtttttggcaattatgaataaagttgttatgaacaactatattgtcaacctgaaataattgaaatgatcagaatccagtttcaaagagtttttaaataagagtttttagatgaacatctgggaatgactaactggggaatatggactccagagcactgggatctgggcttcaaagttaaaagttaagggcctgggccgggcgcggtggctcacatctgtaatcccagcactttgggaggccaaggcaggcagatcaccaggttaggagatcaagaccatcctggccaacatgttgaaaccccatctctactaaaaatacaaaaattagctgggcatggtggcgcctgcctgtaatcccagctactcgggaggctgaggcaggagaatcgcttgaaccagggagtcagaggttgcagtgagccaagatcacgccactgtactccagcctggcgacagagcgagactccatctccaaaagaaaaagaaaaggtgccgcttatttatataggcaggaaacaaagacatttaataggattacaacattttctctgcaaggttggggtttatgagttacaacagtttagttacagattgttttcttttccatatagcttgtttgttttttctttccaagagtgtgtttaacattccatctttttattttttattttattttattatttttttttttttggagatggagtctctttctgtcgcccaggctggagtgcagtggcgcaacctcagctcattgcaacttctgcctcctgagttcaagcaattctcctgcctcagcctcccgagtaactgggactatgggcacccgccaccacacccagataatttttgtatttttggtagagacagggtttcatcgtgttgctggtcacgaactcccgagctcagacagtccgcctgccttggcctcccgaagtgctaggattacaggtgtgagacaccgcgcctggcacattccatcttccaaaaatgtggtagtcatgaagtttttgtgtgaaagaggaggaaagagggaaattaatctgtaatgaatatcagcagttaagaggaagaggaaagacatcttccctggcactcactggttagtcatttacgacattttacagaacaatgtaggtaagaaataaggtaatttataatcagagaagcaaaagctacagctgcctaggttacagttgcctgtttaagtgactcaggtttcataatcacattctcttaaggctcaaaatatttaacaagttccaacagcctagattttgaattacttatttttgcaatatacatatcttttggggtgtgtatattttcatttcttttgggtaaatactcaaaggtatatgcgctgacttacagactgagtaattacttttttaaaatagtttcaagttttattttagatccaaggggtacatgtgcaggtttgttacatgggtatattgtgtgacattgaggtttgggacataaatgatcccatcacacaggtagtcagtacattctcagcccttgcactcctttccctctcctccctctaatagtccctagttttattgttcccatgtttgtgtccatatgtacccagtgtttagctcccacttacacagtatttggttttcttttcctacgttaattcacttaggataatagcctccagctatatccatgttgctgcaaaggatattatttcattcttttcttgtggccatgtagtattccatgatgtatatgtgccacattttctttatccagcctactgttgatggcagctaggttgattccatgtttttgctattgtgaatagtgctgcagtgaatataccagtgcatgtaccttttttgtagaaagatttatttttctttgggtatagaaccagtaatggaattgctgggccaaacgggtagttctggttttttatttatttatttttatctgtctgtctatgtatctatctgtctattgagacagagtttcactcttatcaccgaggctggagtgcagtggtgtgatctcagctcactgcaaactccatgtcctaggctcagacgatcctcccaagtagctgggaccacaggtacatgccaccatgctggctaatttttgtattttttttttgtagagatggggttttgccttgttgcccaggctggtcttgaattcttggctcaggtgatccgccctcgtaggccccccaaaatgctgggattgtaagtgtgagccactgggcctggcttagttctatttttagttctttgagaaatctccaaactgtttttcacaatggctaaactaattacattcccaccagcagtgtataagtgttccctttttggggcagcctcgccagcatctgttagtttttatctttttagtaatagccattctgactggtgtgagatggtatctcgtggttttgatttgcatttttctgtttagttatgtggagcattttttcatgtttgttggctgcttgtatgtcttgttttttgagacagggtctcactcttgcccacgctggagtgcagtggtgttatctctgctcactgtggcctggacctcctgggctcaagtgatccttctgccttagctcccaaagtaggctgaggtgggagagggcatggaagctctgcacccctgcgctgttcctcaccctgtatacaacttcatctgtctgttcatctgtatactttaccatatccttataacgaaccagtgaatgtgtttgcccgcattctgtgagccgttctaacaaattaatccaactccaggagggagtgttgggaacccagctttatagccggtcatcagaagtgtgggtgatgaccttacttgtgtctgaagaagagaggggcagtattgtgggactcagcccataatctcagtgggatctaactccaggtagatactgtcaggattgaattgagctataggacactcaggtgtgtggtatatgctggagaattgcttggtgtgtggggaaaaaccttcacacatctggtcacaagcgtttgtgttaagtgtgagcatagaggaaaaacagtttgtcttttacagttgcttctcaggtaccccttttcttttccccttagatgttcattttgaaggttaagtagagatggcttttcttttgcttactggggtggggcagggggttgtggcatatctgctggttaggggctgttaggatgggtggatttcagttctggtttttactattttgtaactacaaatccttttcccaggggcacactcaaatgtttgattgtccctaatttcactgaacatgtttgattcctgactgaaaaatagaccagaggctctccccctttcttagggttctcttttcaacaactatttcttttcacctctctcctaaccagaggaggttcaaatatatttaagtgctttaaatgtaactttttctgcttggtctttgtgggtatcttcattccagttggttttcttcactttcatttcttttcactttacttcatattctgctaagtctcttataacccctcactgtgattcctatccccagctcccgctaacccccagcatttctgcaagtgtgaagtagactggattcctgaaggttttttttctccctctagattctggcagacattcaaagtttatggtatacgtgcaggccgctctttaaatgttcctggatagtcttttcatggtttgtaattctgctttgcaccactaactttcccaggatggccataggttttgtatgtttaagctgtttcataagcagatctgaaagcatgtctttctaataaatacaaggaatgttttgtgtttctttaagtgaaataattattctaagatcatgaaaaagtgctctgagaaccgaaacaggtagagatttttgtttgattgtgccaggatcagtagtgatgtctggcatttgattggtaagatgttaactagttaggtgctatatgcctgctgactcttgactctggcctagctattttaaaaaaaattcttttgtaattcttgaaagttttcaggtgttttttggaatacttttattattttaggtagtaatcttcagtgacatactatactttttagagagcaagaagtacttgttgatttcacagccttgggaaagatcctaaactgcatgtattcctatatcctttcctttacctaatctgcagtgctatactttgttagactcccagaaaaatggattgggtttttcagtgggcatatgtccaatttgctatgtttcttttattctagccttttttttttacttcctaattctcaatctcagagatttggaaaatagagaagcactgaagagatcttcagtgccttggggcttaaaatgatgagtactttaaattttaagacagccagtctcacaatacgaaaaaccaagaaagggaatggttggctgcctaggtggaaatcaagactgtttgatagaatgaccacaggtacagggcatggttttcagatttcttagtccagtaacacttcctgaagtatgatcaaactgaacattgattcacactaagcttacatgagattgataaatcagacttctgaactttcatcaataattctaatgattaataggacaaaaatactaatctcagctggtcagagcaatttcttaccattattaaattctatctgggaaagctaatgaagatcagatagttactttgtaagtggagtctggtcagaacagtggcatttaggtgatcttaagggatgctgtcatcaagctctggtagcatagaacagagcattttatattttctaggttattactgatacatgcgtgtcattcagaaagagcactttccttaccatatggttctctagacagaaggagcacttctttgtgtttgttcttttgtattgaatatttttttatccgtctaaaaacagcagttattatatttctatattgaagaaactaacgtataagaccagtttgttttatctcaccatttatattcttaagaagctttttaggattacttacttccttctgtgctttgattaaacagtcaaaacccatttctatgtttgaaaagtaggccgggtgcggtggctcatgcctctaatcttaacactttgggaggctgaggcaggtggatcgcatgagcccaggagtttgagaccagcttgggcaacatggcgaaaaccaatctctacaaaaaaaatacaaagattagcctggtgtggtggcgcatgcctgtagtcccaactacacgggaggctgaggggaggatggcttttgagcctgggaggtgaaggctgcagtgagcagagatggcaccatcgcactccagcctgggtgacaaagtgagaccctgtctcaaaaaaaaaaaaaaaaagtagttctatttcctgtcagcagggaggcagcatagcataattaaagtagctttaacttttaatcagactcatttaaagcctgactctgctgtttcccagccttgtaacagtgggcaaattgcttaaaccattttgagtttctgttttctggtaaaatggagataattgcaactctgcaggaagaactagaaaaaactaaatctaaagagttaggaggaaaaccaagaaaaccgatatcctggaagccaagcagtgtgtttctaggcgggggcgatcatctatatcaaatgctgatcataagcaaaaagaggtcagagaagtgaccattggaaataagaatataagatcactgggtttcttcttttaaaaaaaaattaaaaacaaaatatttttagagacagggttgtgctttgttactcagagtggagtgcagtggcatgatcatggctcactgcagctttgaactcctggactcaagtgttcctccctccccagcatctcaaagccgttggggttataggcgtgagccattgtgcctggctactgggtttcttcttgatagtttttggtgaaaggttgaaaacacttacgaacttgaatgggtttaactgggaggagaaggcagagaacatacacaattcctgaggattgtttttgctatagagagaatgagagaagcaaagtagctggagcgagaaatgaacttaagactttttaatagaggaaagaatagcacatatatgtgtgctgaaggtaaagatccaggagggaggcataatgtgatgagaggaaggaagggattgccagagtaatgtccttgaataggcagaatgagggggtggatcgaattgcacaaatggcttacgtgctaagggcagggatagatgggcataggtgggagttcgtagaaagggcccttctggcattctgtttcactgcgaaagtcaggtcatcagctgagagggaggatggaggagtaggtgttagaggtttgaagacagaagtcatctaggagaaggggatagactaggaatttacagtattatttctgggcagtatacagagtctgaggaatgattgctgactggctcactttaaacttacatggtcataggcttttctccagctatgtttagctgcatgggtatacagagtaggtagacaattggttaaaccaggattatgatttatccaaaagaataaaagcgagacaagaacaagggctttgagggaatatgcatgggagtgatgttttatttcacctaaatattttagaatgtatctataatggacaagaatttaaaaaaatcacatacaaccgtaaaactttttttttttttttttgagacaggattcactgtcgcccaggctggagtgcagggacacagtcacatcttactgcagcctcaacctcctgggttcaagcgatcctcccacctcagcctcctgagttgctgggactatgggtgtataccaccatgcttggctaatttttaatttttttggtaagagatggggcccagggtggtgctggtctcaaactcctgggcccaagcctcacaaaagtgctgggattacaggcatgagccactgtgcctgaatcacaatacttgtttaatattaactgatatttagtctatcttcaggtttctctcattttcaaaatcagaaaaaccagatttgtttaagttggaattaaacaaggtctgtacattgcatttgattgctgtgcctcttaagtcatttattccatatgtttcattttactcctctttttcagaccattgatttgttcaagatatttggtcttttgtcatctagaacttctgtattctgcgtctggatgtctgtattcttgtattatttttactttaaaaaaatttttaattgtaaaattcacaacatgatagttactacataagcaagtgtaacgttctgtagtattaaatacgttcacatggttgtgtcctgtggtgttattttaaacacgttcctctagatcccttactttgtgtaaactagtatcagatctagagaggctggatttgattcaggttcagtttttaactttgttggtgaggggtcaaggacataggtggtttatgtgtacttctcatggtgtcttattgggaagcacgtaatgtctggttgtcctaacgatgagactgatcattgggtttaggtcttgtagcccaagggttctcaaccctggtactcgtccatggcctgttaggaactgggtcgcacagcaggaggtgagcggcacgtgagcaagcattactgcccaaggtccaccccgtcagatcagcagcagcaatagattctcataggagcacaaaccctcttgtgaactgcgcatgcgagggacctaggctgtgcgttccttatgatgcgatctaactaatgcttggtgatctgagatggtacggtttcatcccgaaaccaccccaccctccccaaatctgtggaaaattgtcttccacgaaactggtccgtggtgccaaaaaggttgggaaccactgttgtagcctgactatccatttaaaaattttccactgattttttttcacacttaatggttttattaaccattgatcattgcctagatccattattttcttagagattgtaaactgattattttctaattatgtaactctttttggatttattagctagaattctgttaaaaacagtcactcacctagtttctgccagaaatgcaggataaatgtttgattcttttattatttatttatttatttattttttgagacggagtctcgctctgttgcccaggctggagtgcagtggcacgatcttggctcactgcaagctccacctcccgggttcacgccattctcctgcctcagccttccgagtaactgggactacaggcgcctgccaccatgcccggctaatttttttttttgtatttttagtagagatggagtttcaccacattagccaggatggtctcaatctcctgacctcgtgattcacccgcctcggcctcccaaagtgctgggattataggcgtgagccaccatgcctggccgattcttttattttctaattttcaggtgactgagttttttgatttttagataaaattatgaattcatgaagttcatgatgactcagttgcagtcatttttctgatgttcagattgtctcatagttggtcagtggaagcttcttcaagctggcttctgtgtcccccacagctgctgcacccttgttagcttcacagcttgtttgtatctgtcttgtcctgtgcttggaataatcaatttctgcaagaagctcctagtttctttcagtgggaaatggtagagattgtaatatgggtgtccacttttaaaagatgtgggtcgggcatgctggctcactcctgtaatcccagcactttgggaggccaaggcgggcggatcatgaggtcaggagttcaagaccagcctggccaatatggtgaaaccccgtctgtattaaaaatacaaaaatgagcccggcatggtggtgcacgcctatagtcccagctacttgggaggctgaggcagaagaattgcttgaagaggttggagtgagccaaaatcgtgccactgcactccagcctgggtgacagagtcagacttcgtctcaaaaaaaaaaaaaaaaggtgttgtggcttttgtttatttgattttttagaatactgattggtttcttttcttaacaggcatgcccaaagaaaaatacgagccccctgaccctcggaggatgtatacaattatgtcttctgaggaagcagcaaatggaaagaaatcccactgggcagagcttgaaataagtggtaagacatggaagcatgaatttatggtatggaaattaagatatggtagtaaactgagttttctaatgccaatacaggaaagaaacattgattttatattttacaaatgtaatgtatttataaatgattgtattttagtaacttatcttagaagcaggaaggttcaatgaaaagaatatgatttgagtcaaagttcaaaagccattcattgaatattttctcagtatcagtgtcctcttacaaaatacataaatgtaaaataataacaaggatgaaatgaaaataacacatgtgaagtgctagtgcccagtcacgtatttgttctggtatttgattctctgataaagtaggattgagcttttgcattgtcaatgatagatttctggtggggtaggaatggctgatctgtataggttttgggtaggtttgtttctccttattttcttcattggcttctgagtctgagtcactgaggacagccttattcagaaacacaaaatcttaagagtttgaagaagatctcaaatttcccttccccttttaatgcaatctggacatattcaaagaaatatatgagccctcagatgtgaaggatatcctttccccagcatctctgccagtgggcacacagtctctttttaaatattttgaagatggtgaagggacattacttctcagggcaaccagtgctaatgaagttttgtgttactgttggcctattatgcttccccttactttcctttcagtttgttctgatttttgccttctaaaatagtacagaacaaattttgtcgtctttcacctgaccgcccttgatttttaaaaatttaatgcagcagacatactgagcatatgctgtgtgtaaaacattttacctggcgctggcccacgtgcgtggaagatctataaagtcccgctttttatggagcttatgacattagggagtgagagggagtgcacaagtataaataactaatagacaaaacataacaaatctaggtataaaagtgctatataacaggaagcaaaaaggaaataaggataatagcattcctcctttgtcagctcaaaatttctggttaacctgttgagtaaacttaaatgcctgcctttgcagccatagtagaggtcagtacacacacgggtctctcctgttttccctcttctgatttcttttttttttttttttttagtttttattgatcattcttgggtgtttctcggagagggggatttggcagggccataggacaatagtggagggaaggtcagcagataaacatgtgaacaagggtctctggttttcctaggcagaggaccctgcggccttccgcagtgtttgtgtccctgggtagttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaaccgccgttgtcatcatggcccgttctcaatgagctgttgggtacacctcccagatggggtggcggccgggcagaggggctcctcacttcccagaccgggcggctgggcggaggcgccccccacctccctcccagctggggcggctggccggggcggctgccaggcagaggggctcctcacttcccagacggggcggctgccgggcagaggggctcctcacttctcagacggggtggccggtcagagacgcttctcacctcccagacggggtagcggtcgggcagagacactcctcagttcccagacggggtcacggccgggcagaggcgctcctcacatcccacacggggcggcggggcagaggcgctccccgcatctcagacgatgggcggccgggcagagacgctcctcatttcctagacgggatggcggctgggaagagacgctcctcacttcccagactgggcggccgggctgaggggctcctcacatcccagacgatgggcggccaggcagagacgctcctcacttcccagacggggtggcggccaggcagaggctgcaatctcagcactttgggaggccaaggcaggcggctgggaggtggaggttgtagcgagccgagatcacgccactgcactccagcctgggcaagattgagcactgagtgagcaaaactccgtctgtaatcccggcacctcgggaggccgaggcaggcagatcactcggggtcaggagctggagaccagcccggccaacatggcgaaaccccgtctccaccaaaaaatgcaagaaccagtcaggcgtggcggcgcgtgcctgcaatcccaggcactctgcaggctgaggcaggagaatcaggcagggaggttgcagtgagccgagatggcggcagtacagtccagcctcggctttcacaactttggtggcatgagagggagaccggggagagggagagggacccctcttctgatttctagaatgctggactttattaaaccaagttcagctcagtaagtaggtgtggtcatggagagtgaaatttctcttcttctcacctgtcagatttggctttctgtgccaggggagcccaaagagaaatatgcactaattttgtagttattctcaaagcacagtcagtcaccactcctatttttcccttttaattttttcaggattggcatttgactatatttacctctccttttttcagcccttattagcagtttttgcattacaattcctttgcttgtaaggaagtgtcccctatcttacagcattaggatacgcaagaaagcactcaggtcattgagatacatctctgaggctgaggagattctcctccaccctctcctccttccaccacatgctgtgaactccttggtgactttgagtcactgttctctgcttaccctgaactttgggaagaagttctgtatacacatatagggaaaaaccctcaacccatgttttttctttgctctcacaccaccacagtcatcaacacaaaagaagacttctgtgaccaaaggtgtgggtttcttttccccacacagcaagcagcagacaccagttaggtgccctccaattcaattccaacactgtcttcctggaggtagcatcagatcccacggtttgtggactcagtccccaagactgccctctcccacttctatcaccagtcccatgtttgggcctctagagctttgaccagcttcaggttggggttcccacgaccccctctttgggttcagttaatttgctggagtggttcacagaactcagagaaacatctacttacgtttaccagtttattataaaggatattacaaaggatacagatgaaaagatgcacagggcaaggtgtaggggaaaaagtgcagtgtccatgccctccctgggcacaccacccttcaggaggaacctcgtgcattcagctatctggaagctctctgaaccctgttctttcgggtttttatggaggcttcattacataggcatggttgacagctgtagaaatgtgattattagacaagcaaggcatgtctgctcagacttttcttgggctgtgtagcattccttcttctaaggtatggggcaggaccctctctggaatgacggtcttctgacccacagtgagattagagtcctgccttgggcaggggaaaggaggataggagaaggtcatagatcctgtttcctgaggccttaagcactctaacattataacaaagactatgggagttaggaaccaggaaccatggatgaaaacctatatatatatatatatatatatatatatatcaccgtaatacaacataggaaggaagaggggagacgcctctaaagtaacctttcttaatttattgttattattattatttagagatgaggtcttgctctgttgcccaggctggaatgcagtggcatgattatacatagcttactgtatccttgaattcctgggctcatgtgatcctcccacctcaccctcctgagtaactgggactacagactcatgccaccatgcccagctaacattttaaaaattttccttagagataggggtctccctttgttgcccaggctggtcttgagctcctggcctcaagcagtcctcccgcgttagcctcccaaagtgctggtattacagacataagccaacttacttagcccagattggcttctttaacttatttatttcatttttatagatttaggaggtataagtacagttttcttttttatattttaacaatctgtttattatttatttatccctccatagaaccaccactcacaccaaggagattatttggagtgggtcaccacctggggcctggactctgaaatctaaggcttcctcctccctcactttatggcttaggtggtggcatggttcaggcaaaactcgtgtctccttttggatactgcagaagcaggacctaagcatacccataaaggtggccacacccatcagggttgattggcaggctggaagacaatattctcccaatgaaggcacttttacctctataggggggtgggaattggttggttggaagtggtggtgttgggacagggaagagttatttccatggaaaacttatttgcaggttacagagagaaatgaggggagtttgcctacactgggccatctgtggggccagtgggggctgctgtatatcttgtatatctttgctaccgaaaggggaaggttgacgtaggcattaaagccaaagaggcccttagcaattaggcccagtacccctgcgatgattttggagtggttttctttctcaacattgtcgataatggaggtgattaggtagaggatcactgctaagagggtttggaagaaatgactccagggccaattgatgaatggtattttggtgtgcagatcacacacgtagctgacaaagtagcagcaagtatcatttcagccaccaacagggaggaatagtctggtgtggaggcacttgaagtagatcaggatcaccaggcacaatgtaatcttagcaaacctggaggattcccttttgggtgcgcaagaagttggcctcagcagcgggggtccgagaggccctcggaatccaccatggcatgggccggagtcgctggggtccgagaggccctcggaatccaccatggcatgggccggagtccctggggtccgagaggccctcggaatccaccatggcatgggccggagtccctggggtccgagaggccctcggaatccaccatggcatgggccggagtccctggggtccgagaggccctcggaatccaccatggcatgggccggagtccctggggtccgagaggccctcggaatccaccatggcatgggccggagtcgctggggtccgagaggccctcggaatccaccatggcatgggccggagtccctggggtccgagaggccctcggaatccaccatggcatgggccggagtccctggggtccgagaggccctcggaatccaccatggcatgggccggagtccctggggtccgagaggcccttggaatccaccatggcatgggccggagtccctggcgacgcagaagatgtgctcactgattcgtggggtggaggacactgcacacccagccatctggctaggaagggggcgtctggggcagagggagtcacaagtacggttttcttaccggatatattgtgtagtggcaaagtctggccttttagtgtactcattgccctaatagtgaacattgtacccaaaaggtaactttttcacctttttcgccctcccgtgttttggaatcttcagtgtctgtttttccattctgtatgtgcatgtgtacccattgtttagctcccacttgtaagtgagaacatcggtatttgactgtttctgagttgttttgcttaggataacggcctccagttctgtccaggttgctgcacaagatatgctttcattcttttttataactcagtagtatttcttggtgtatatatacactgcattttctttatccagtcatccattgttggacacttaggttgaggccgtatctttgctattgtgaatagtgctacaatacacgagtgcaggttatctttttgacatgatgatttctttccctttggggatacccagtagtgggactgctggatagaatggtagttgtatttgtagttctgtgagaaatctccatactgatttccatacaagttgtactaatttacattcccaccaacagtgttcaagcgttcctttttcttcacatccttgccagcatctgttgtttttgactttttaatagtagcctttctgagtggtgtaagatggtatttcattgtggttttaatttgcatttctctgatgattattgatgttgagcatttttttcgtatttgttggcaatttgtcttttgaaaaatattgtttcatgttctttgcccacttattagggtttttttttttttttttttttttttttttgacagtctcactctgttgcccaggctggagtgcagtggtgtcatctcggctcactgcaagctctgcctcccacgttcacaccattctcctgcctcagcctcctgagtagctggtactacaggcacccgccaccacacccggctaattttttgtatttttttttagtagagatggggtttcaccatgttggccaggatggtctcgatctgctgaccttgtgatccgcctgccttggcctcccaaagtgctgggattacaggtgtgagccaccgtgcctggcctagggttgtttttttcatgttgagttgagttccttgtagattctatatagtaaccctttgtcagatgtgtagttgccaatattttctctcattctgtagtgttaattatcattattattatttttgctgtgcagaaacttcttaatgtaattaagtcccatttatctatttgttttgagataagatatcattgttctgtggcccaggctggatggagtggtataatctcaaactcctgagctctagtgatcctcctgcctcagcctcctgagtagctgggactacaggtgcacacaaccatgcctggcttttttgttttgttttgttttggagacaggatctcactttgtcacccaggctgtagtgcagtgatgccatctcggctcactgcagcctcgacctcgtgggttcaagcaatcctccttcctcagcccctcaagtagctgggactacagtgcatgccaccatgcccagctaaaggcaagtttttatattttaattttttgtagagacaggggtcttgtgtttcccagcttggtctctaactcctggcctcaagtgatcttcctgtcttaattttacaaaacactgggataacaggcatgagccactgtgcccagccagcttctttaacttagtaatagatgtttatgttttctctgtgtcttgtcatggcttgatagctcattcttttttagcactgagtaatattccattgtctggatgtaccagtttatttacccagtcacctactgaaggacatcttggttgcctccaagttttggcaatttttggtaaagctactataaacatctgtgtgcagttctttgtgtagacattaagttttcagctcctttgggtaaataccaacgaggcatgattgctgaattatatgggaatagtgtgtttagttttgccaaaaagtaccaaactgtattctaaagtggctgtatcattttgccctcctaccagcacatccttttccggatttggtggtgttagtgttttggatttttttgccatcctgataggtgtgtagcagtatctcgttgttttaatttgcggttctctaatggcatatatattggccatcttttcatatgcttttttgccatgggtatatctgctttggttaggtgtgtgttcaaatcttttgcccgtttttaaattgggttgttttcctattgttcagttttaagagttttttttttaaacttttaaaaaatgcggatatgtcttttgcaaaaatatctcccggtctgtgggttgtcttactcttttgaccgtgtctttcacagggcagaagtgctgaatttaaatgggactttgggattctgtttagtctatatatcaaattaggaagaacatcttgacagtattgtgtcttcatatctgtgaacatagaatatctccatttatttagttctttgatttcttcagaattttgtggttttcctcatatataatttgtaaatatttagttagatttattcctctttctctctcttttttttttttttggtgtaaatggtgtatttttaattctgaattccatttgttcattgccagtgtataagaaagtgactaacttcagatcttttaagtattcgcttatttgtgatttaaataagttttaaggctgggtgcagtgtctcacaccagacccagcactttgagaggccagtgtgggtagattatacagtagaccagcctgggcaacatggtggaacatcatcttttttttttttttttttttttgagacggagtctcgctctgttgctcaggctggagtgcagtggctggatctccgcacattgtaagctccgcctcccaggttcaagccattgtcctgcctcagcctcccaagtagctgggactacaggtgcccgccacaactgccggctaatttattgtattttttagtagagacggggtttcactgtgttagccaggatggtctcaatctcctgacctcgtgatctgcctgcctgggcctcccagagtgctgggatgacaggcgtgagccaccgcacctggccggaacatcatctttattaaaaaatacaaggattaatgtagttaattctcatttaatcccttcttaggccaggcgcggtggctcacgcctgtaatcctagcactttgggagactaagggaggccgattacctgagctcaggagtttgagaccagcctgggcaacacagtgaacctccgtctctactaaaatacaaaaaaaatttgccgggcatagtggcgtgctcctgtagtcctagctagtcaggaggcctaggcaggagaattgcttgaacccgggaggcggaggttgcagtaagccaagattacaccagcctgggcgacagagcgagactctgtctgagaaaaaggtatatatatatatatatatatatatatatacaaaaaaattagccaggtgtggtagtgtgcaactgtggtcccagctacccaagaggctgaggtgggagcattactttactttagcccaggaagtggaggttacagtgagctgagatcgcaccactgtactccagcctgggtgatagagtgagaccctctctcaaaagaaaaaaaattgtctgggtacggtagcttacgcctataatcccaacactttgggaggccagggcaggcagatcatgaggtcaagagatggagaccattctggccaacatggtgaaaccccatctgtactaaaaatacaaaaaatgagctgggtgtggtggtatgtgccagtagtccctgctgctcgggaggctgaggcaggagaatttgttgaacccgggaggcagtggttgcagtgagctgagatcatgccactgcactctagcctagcaacagagcgagactccatctcaaaaaaaaaaaaaaaaaagtcagccaagcaggaggattacttggactcaggagtttgaaagcaccctgagcaagatggcaaggccccagagtgagaccctatctctttaaaaacaaacaaacaaaaaaaaactgcatttcctcctccttaaatttttttttttgtagttattcattattaggctccttgtagtttagttttcctttactgagcttttctaaattttttgttcttttcttgcttctatcattttttaaatatctttcacctcattttgaaatactaggtaatagttttttgggcatgtttggagtatgcttttatagcaacttattaaaataatttttttgggatttgacttcagtactttttctgttcttttttttttttttttttttttttttttttttttttttttttttttttttttttttgagacggagtcttgttctgtcactcaggctggagtgcagtggtgtgatctcggcttactgcaagctctgcctcccaggttcacgccattctcctacctcagcctcccgagtagctgggactacaggcacccgccaccacacccggctaattttttgtatttttagtagagacagggcttcaccgtgttagccaggatggtctccatctcctgacctcatgatccgcccgcctcggcctcccaaagtgctgggattacaggcgtgagccaccgcgcccagcctgttcattttcatttgaattcagtttttctaaacttagaagatgtgactcagggtagttgtactaatgtctgtgctcccttttctgtagttttcagagtgttcacaactgtgggaacttgctttctgagactttctggttctgttcctctctctcatttttatctttttccttcatcttttttattcctatcctactaattttaattccatttttggagttttttctcagtgtggggccttgactggtcagttccgagggtccctggggcagagactgttggacgcttccattttagacttactgtggacaccctgtactcacttgtcactcattgggactatatcccccttggttgtagtgatgttctgaaactggtgctttccagtgtataccagtgggtttccctttttttagttccattaaacacatttacatttaatgcagttattgatatgattagggtcaaataagtaatattataccatttcactcataaaagtcttacaacaatatacaggcagtctctggctcacgatggttcgccttttgatagtatgaaagtgtcatgcattcagtagagaccgtaattggagtacccatatgaccattctatttttcactttcactacagtattcagtcattacatgagatattcaacacttgattaaaaataggcttagtgttagatgattctgcccaaatgtaggctaatgtaaatattctgagcacatttaaggtagattaggttgagttatgatgtttggtaggttaagtatattaaatacattttcgacattttaaacttacaatgtttttattggaccctaaccccattgtaagttgaggcgcacctgtatttctgtttctcctctcctggcctctatgctattgtagtcatgtatgttatttctccatatggtgtaagtctcaaaatacattgttattttactttaaacactcaagtaataggaaaattggttagtatttttccgtatacttagcatttccaatgtttttcatttctttctagtgcaagtttctgtaattttccttctgacaaaaagacgtaatggggtctgccagtgatttttttgtttttgtttattttttgtattttaggttttatgtctggaaaagcctttctgttgacctatttttgaaagaggtttttgctgagcatagaaatctagattgacagttcatatgtttcggtactttattttctttcttctttttaaattaaattaagaattttttttttttttaagatggagtcttactctcttgcccaggctggagtgcaatggcacaatctcacctcactgcaacctccgcctccctggttgaagtgattctcctgcctcagcctcctgagtagctgggattacaggtgcgcaccaccacatctggctaatttttttatttttagtagacacggggtttcaccatgttggccaggctggcctcgaactcctgacctcgtgatccacccgccacggcctcccgaagtgctggattacaggcatgaaccaccacaactggccaagaaattttttttttttttttttttttttttttgagacagagtttcgctctgttgcccaggctagagtgcagtggtgcaatcttggctcactgcaagctccgcctcccggattcacagcattttcctgcctcagcctcccgagtagctgggactaacaggcacctgccatcacgcctggctaattttttgtatttttagtgaagacggggtttcaccttgttagccaggatggtctcgatctcctgacctcgtgatccacccacctcagcctctcaaagtgctgggattacaggcgtgagccaccatgcccggccagagaaattttttttttttttggtatttttttgtttttgagatggagtcttgctctgtcccccaggctgaagtgtagtggcactatccggccagagaaatttttttagcagacggggtctcgctctgttgcccaggctacagtgccccctggctgtttacaggcactattgtgatacactgcagcctcaaactcctggcctcaagcaatccttctgccttcctagtagctgtgacgatttggaaggcgtatgtcatggtgagttcttccgtgttgctctgtggccttccagcgtgcattgtttctgagaaaaggtcattcttatccttgtttcttttatgtatgcctgttttctgtggctgccttaagagtctctcgccattactcttttaagcagtgtgataatgatgtgtcttcgtgtagttttcttttgttcttttatttctcttgtgctgcttaggttttgctgaggttttgctgagctcgtcggctctgggtttctggtttgggctaccaatttttttttttttttgagacagggtctcgctctgtcgcccaggctggagtgcagtggtgcaatctcggctcaccgcaagctctgcctcctgggttcacaccatcctcctgcatcagcctcccgagtagctgggactacaggcccgcgccaccacacccagctaatttttttatttttagtagagacaggatttcaccatgttgaccaggcttgtctcgaactcctgacctcaaatgatccacccaccttggcctaccacagtgctgggattacaggcgtgagccactgcacccggccgcttgttagtttttttctatatctgcaaatgcatagttattttgatttcctggtaggtatactaattacacctagttcttttagtgtttgctaatcacccacgtgatttcagaacacataaattgatttctcttgtctcttagcatttagcaataaaggatcctgggtattttataatgaaatcacttatcaaaacagggctcttaacataggtcaggataatcccagccttcctcaagtcactaagctgcttaaaagtaaatgcaagtttttgggtacttatgagtatgtacaattttgtggggaagaagtagatagatatgagattatcaaaaggtgacttccttttgttcattgacctcttcctgaaaattaggatccttaatttcttgtattgcgtagttcaatggtagagatatatctttctctagtacattatgttcttttacttctgttactaatcttttaaactctgaatttttttaaatttatttatttatttatttatttttgagacggagtctcactctgccgcccaggttggagtgcagtggcacggtctctggtcactgcaagctctgcctcctgggttcacaccattctcctgcctcagcctccctagtagctgggactacaggtgcctaccagcactcctggctaaattttttgtgattttaatagagacggggtttcatcgtgttagccaggatggtctcgatctcctgacctcgtggtacacccacctcggcctcccaaagtgctgtgataacaggcgtgagccagtgcacccggcctgcactctgattttttaaacaaaaatgaagtaccatgttttgaagtttgctttttttgcttcatttgttgtgaacatagttccacatcagtgtatgtaactatttcattctaaaagagaatatggctaaggaatgttacatgaatgaaacgtaattcagtatgctcgattcatgatcgtttatatttctaattttccccaacaatatatgtcttagcatacctgaacaagtgttttcataaggtaaatcacaaattgtggaattgatggggcaaagacgactcagctttaaaattttagtagatattaccagattggcttcaaaatagttgcatgtttcccaaaatgaaagaatgtgtctgtttcccccttcttgtcaatattggatattagtcttttttattttgctatcgtaaacatttttttattactgagtttgaagatttatttttaatatgactttttttttttgagagggagtcttgctctgttgcccaggctggagtgcagtggcacgatctcagctcactgcaagctccacctcccaggttcacgccattctcctgcttcagcctctcaagtagctgggactacaggcgcccgccaccacgcctggctaatttttttgtatttttagtagagatggggtttcactgtgttagccaggatggtctcgatctcctgacctcgtgatccacccgcctcgacctcccaaagtgctgggattacaggcgtgagccaccgctcctggccatgactttgttttttaagtgacctattcttatccattgttcattttcctgttgatttctttgttttcttttctctcattataaaactcacaggaaatcatgagggcaggcacatgctattatttaccattctatccccataccagcatggtggatactgaaaattgactgaataatggttagcttcccatataagttggtgtcttcaccatatagaaagaagttttacattttaatgaattcaaacctgacaactgttttcatatttgaattctagtgtttgagttatgctgataactattctgtttcatttctttcctggttttttggtacttagaaatttattccagaatcgtgtgtgtgtatggtaggcatccgagttctccttgtcttcctgcctctacctcatatatgatttattcctttacttggctttttttcctttcccttattcccagactttgtggttttctttctggctaccttctaccttcttgaattgtcagcttatttttctggcagatggaattatgatcaccctgtatgggaaaaggagctatacaaattggcaggctttgaaaatgaaccgccataaatccgtagaagttgtatgtctccattcaggagctctgtttgcttctttaggcatacccttcccctctcttgagtgaagagggcaaagacacagaaaacttagtagggaaccaggcgcagtggctcacgcctgtagttccagctacttgggaagctgaagcaggaggatcacgtgagcctaggagttaaaggctactgtgagctatgagcaagcacaccactgcactccagcctgggtgacagaatgagaccctgtctcaaaaaaacaacaaattgttttatattaaatgccttattcatattgaatatcagctgtgtgttttcagttttatgaatggaaaattaagtaaataaaattttgttctacaaatagcttgtggtatggtgtctgttctgtttatagcaaagtaagggaaataccttcttagattaagatagattttattatacagttttactgaagtttagttgacattcaaaattggcgtgtataaagtgaataatgtgtatattttgactgtgtacacccgtgaaaccatcaccacaatcaagaatgatcatattcatcgatcctgaaagtttgtgatccttccttccccacctctcctgtttctccattccttcccctatttctaagcaaccgctgttctgctttctataaccatagattagtatgcattttgtggaatttttgtataaatgatgttatacagtatgtacccttttttctttttttcatgaaaatggacaccttgcattttttttgttgtttttggtgattttggtctgctcttatcctctatacttatcctgtagttcatccatagtgttttgttggtttttagtagttcattcttttttattactgagtagtagtccattgtatggctacgccagcatttgtttatttgttctcctgttgaacacacttgggttgtttccaatatttgactattacaaataaagctgccgtgaacattcccctttgtgtgggcataacttttatttcctaaaaaatggaattgatcatatggtaagtgtatgtttaactttttaaaaaactgaatctggtttgcaaagatgtcttgtttcatattcctactagatgtctttgatccatgccctcaccaacacaagtcttaaatttagccattcttctgggtatgtagtgctatctcagagtggtttaaatttgcatttccctaatgactcccaattttgagcatcttttcatgtgattatttgccatctgtttatatcttctttggtgaagtgtctgttagatctttcactcggtttgaaaattatgttttatttctttctctctctttttttttagacagagtcttgcttggctaattttgtatttttagtagagatgggggtttcaccatgttggccaggatggtctcgatgtcctgacctcatgatccacccgcctcggcctcccaaagtgctgggattacaggcatgagccaccgcacccagcccaaccatttgattttaatgtggttatttctatggttaaatttaaaattcaccatcttgctatttttttattcatatcatttattctttgttctattttttcttcactctcttgttttgaaataataaagcttcttctattttttcttcactgtcttgttttgaaataatagagctttttttaaatcattccattttacctcctttgtttgacttttagcgataactcttcgatttattagttagggtttatggtgtcttatacttaccacagtgtgctgtcaagtactagtacacctctttacatgcagataatagcccaacagtacacttttgtttcctcctcccatccattatttctttgtgatgtgtcacttctgcatatgtcataacacccacgttatcttatttctaatattgctttaagtagtcaattacattttaaatagttgtagagaaaataatctcatacatacccacgtattcactatttctggtgttcgtttctgttaatgtagatttccatctggtattttatttcttctgcttaaagaattttctctaatttcctatcaggtagatcaactggcaatgaatcatttcaccttttctatacaggttgagtattgcttaactagaatatcccttgggatcaaaagtgatttggatttcagatttttttattttttatttttgaatgcttacatatatgtatgtgatgagatatcttggggttggaacccaagtctaaaacttgaaattcatttatggttcatacatactttatgcaaatagcctgaaggtaactttattcaatgttttaaattttgtacgtgaaaccaagtttatgtacattgaaccatcagaaagcaaggaagtcactatttcatgtcattgttcagaaagttgcaggttttggagcattttggattagggttgctcaagctttgtcagaagttaatttgccttcatttttggaagctatttttggtaatttgctaggttgacaggattttttttttccttacagtaaagtttttactcctggccaggcgctgtgcctcacgcctgtattcccagcactttgggaggccacagtgggcaaatcacctgaggtcaggtgctcgagaccagcctggccaacatggtgaaaccccatctctactaaaaatatgaaacttagctgggcgtggtggcgggcgcctgtaatcccagctacccaggaggctgaggcaggagaatcgcttgaacctgggaggcagaggctgcactgagctgagatcgcgccactgcattccagcctgggcaacagagcgagactccatgaaaaaaaagagaaaagaaaagaaaattgtgctcctctgtcagtctctcttattgtttacagctgggagtctgctgcattttatctttgctcctcccatatgaaatgtttttcccctctggtggctttttagattttctcttttaagccatttggttaagatgtacatgtaattttcttttatgaaattttcatacgtttgagttcatggagttgtttgtttgtttgtttgttttgaactggagtctcactctgtcgcccagactggagtgcagtggcaccagctcagcccactgcaaccgccacctcccgggttcaagcggttctcctgcctcagcctccctagaagctgggattacaggcgcccaccagcatacctggctaatttttgtatttttagcagagatggggtttcaccgtgttggccaggctggtcttgaactcctgacttcaggtgatctgcccgcctcagcttcccaaagtgctgggattacaggcatgagccaccgcatcctgccctcattaagctttttgtatctgtgagtttagagttttcatcaaacatagacattttctgctgttttttcttgtgtaataccttgagatacaattcacacactgtacagctcacccatttaaagtgccagtttagtgggttttgtatattcacagagttgtgccacatttgccacaatcagaacattttcatcatcccaaaaacgaacgctgtacccatttagcagtccttcctctgacatttaggaacgaagtctagcctcagttctgtgtgaacttgggggttgctgcctccaccatcctttcaggtgtttttttccctctggctcaggtagtttctcacatgcatgtgtcgatcaataccctgttgacaacttgagccagggagtggggggccccatcagatctccagacttctctctgttctcttctcttctctctgatgttctgcctcttgatttctaatcaccttggcttccctggactttctgtctctggaactcagggaggatcactgtcctctacctgggattcccctccttgggctgcctcctgtaagtgctgtccaaggagtaagctgagacagttatagggtctaccctgtttgtttcccacccttcaggaatgactctcctgcattggttggtgtctcatcttagaaatttgctgattcatgtatattatctgatacgatggttgtcacaggtggcatggtaaatttagttcctgttactcttatcttggttggaagtctcaaggtcgcgttttcttcagccaatagaaaattaatcagttctgaaagactggtatgtttttattacatttgtttcattctctctcagattagatcctgaaccagtaaggagattatggggaacattcttagattgtagaaaccattgacaatttatcaagaagtgtcaaagtgcagatttactgttgcattgaaaggttttatcattctgttcttagtcactgaatcttatgcctactactatttgattataaaggtctgacttactatctgaagcgtttctgggcaagtgtttttacttgttaccatataatacaaaatgctgcttagccatgtggttcttcatgcagttatcactagggtactcagttcttaaaactcagctaagagtaccttgtgttcctttttgtttttaggcaaaattcttgttttctggagatatgaacagcctctgagatagtagaatttgtgttattttgcataagtccaaaccagtcatgacgttcagatattggatttatcattactataaattaatcatatttccctctcatatctgagatcattttaaaggataaatttggccgggcacagtggctcatgcctgtaaccccagcacttttggaggccaaggcgggcagatcacaaggtcaggagatcgagaccatccttgttaacaccgtgaaaccccgtctctactaaaaatagagaaaaattagccgggcatggtggcgggtgcctgtaatcccagctacttggaggctgaggcaggagaatggcatgaacccgggaggcggagcttgcagtgagcccagatcacgccactgcactccagcctgggcaacagagcgagactccgtttcaaaaaaaaaaaggataaattatttttgtgctcctaaaaataaagatgcactctaagtagtattggtacattaactttttattttaacctgctaagtgaggagcttataacttaatcatagcaatgaatcgtagaataggtaagatttcctgttaaccccttctcacaagtttttggataataatttaagttactcataaaaacatctaaatcttactgaaatctacagaacaaaatgtagagaaaactatataatccgttcctgtatttttttctcttacaggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcaggtatgcagattcaacttaatacatactagctatatgacccctaaaacaaaatataggccgggcgcagtggcttatgcctgtaattctagcgttttgggaggctgcgagaggatcatgaggtcaggagatcgagaccattctggccaacatggtgaaaccccatctctactaaaaatacaaaaaattagccaggcgtggtggcgggcacctgtagtcccagctactcgggaggctgaggcaggagaacagtgtgaacccgggaggtggagtggcagtgagccgagatcacaccgctgcactccagcctgggtgacagagcgagagtccatctcaaaaaaaacaaaaacaaaaaaacatttgttgtgttaggaaacaaaactgttcatttaatggtatttgaataaaaggaaacataactatatcctttataactttatagttttgtttttgggaaaattgaatgtcagctaataataaattaagtagatcattggctgaattttttaattactgtattttgtgtaatagactttatttttgaatgagaaagtttggacagagagtgggtagactgcaaggtgcttatgttatcccacatacttcctcatgacaaacagggcaccataccatccttaacacagggtccaggaaaccattgccagttggtgaaacctttttgccatcccagggcttgtatgtttgatagtagtaaagcctggacttgaaggagctataattattaaatttgggggcctgtagcatgaaatatatagcatttggattcacatgtgtaagttcaggttggaatcttaactttgccatttatgagttgtgtgatcttggacaaccttcttgacccaggataagggatgtttgagataatgggtaaaaaaacactagtaccttgcctggcatatactgtgttttaagaaatggtaattgcagactgcatgtggtggttcatgtctgtaatcccagtactttgagtggctgaggcgggctgattgcttgagcccaggtgtttcagaccagtctggtcaacatagcgagaacctggtctctacaaaaaaaaaaaaaaatccccagataattagctgggcttcgtggcatgcacctgtagtccctgctacttgggaggctgaggtggagggatggcttgagcccaggaggttgaggttgcagtgagcagagatcatgccactgcactccagcctgggtgacagagcaagaccctgtctctaccctcctcccctctagaaaataagaaagaaaagaaatggtcattgctatgtttattttgatagagatgagggtctcactatgttgcccaggcaggtcttaaactcctagcctcaaaagatcctcccatcttggcctcccagagaattgggatttcaggcatgagccactgtggctggcccatgattattattattattttacttctgttttataaggtagataagatctaaccaagttaatataaagctaaattccatgtattatgttaatcccaatggaatattttgtactatttcatgttaactgactttttgacatggttccactggctttcctgctgccttctgccattagccatgtagtaaaaaggaataaggaccttttgaaaggtctttgcctctattgctcctactccagccttttgacttttttttaggtttaattgagtttgttctatgactgtttttagtcctctgaaacaaatttacttgaaggacctcctttttctttttctttttttttttttggagacggaattttactcttgtcgcccagactggagtgcaatagtgtgatctcggctcactgcaacctctgcctccgggttcaagtgattttcctgcctcagcctttcaagtagctgggattacaagcgtgtgccaccatgcccagctaatttttgtatttgtagtagagacagggtttcaccatgttggccaggctagtctcaaactcctgacctcaaatgatctgcctgcctcggcctcccaaagtgctgggattacaggcgtgagccaccgtgcccagcccgagggacctccttttttctgtatattgtatttggaaataaacaggagccagatatcagaacttgctcttcttgttgagtttacagccacacagaccttctggcttgctcagtaaccaagattcatttaaatgtcaaaaaccaaagattatagaaatagatttcttgcacacttaaaaagtgacaaataggctgggcacgatggctcaagcctataatcccagcacactttgggaggccgaggcgggcggatcacaaagtctggagatcgagaccatcctggctaacacggtgaaaccccgtctctactaaaaatacaaaaaaaaaaattagctgggtgtggtggcaggcacctgtagtcccagttactcgggaggctgaggcaggagaatggcgtgaacccgggaggcggagcttgcagtgagccgagatcgcatcactgcactccagcctgggcaatggagcgagactccgtctcaaaaaaaaaaaaaaattgaaaaataaaactgcatgcgttacattgccactgtgtccgtattgggtctctggtggttctttccccgcgtgtccccccggctcacccttgaaggttcctttgatatttatatcatgattatctctgcaaaacaaatcatattaagaataatcatgaacagttaatacagctgctgttattttttaaatgcaactttagttgatagcaatcataagcttaattatgcagctgttacgagctcttttgagtcgttaacgaaatgatcattttagttctcttttaagaattcacatggtaggctgctttatcatttccactttcttaaatgtgtagtagaccccatgtgtactagaccagtgatactcagtgtggtctgtgacctggtgccagtttgcaaactgtcttgccagtctgcagtgagattaatacagcagttgaggaattttatatgtctgttaaatctaatactttttaaaaattgggtcttacattttgtccttttcccccattatttcattttctctagtaatttgtttcttgtattctctggcagtttttttttttaaaccacatgttatttaagaaacgcagtactagacattgaaatataacgtaacattttttcattcttaggtgcttatgttcctagaaactatgttgttgattttaactgttaaaggctaacatatttttctgacttcctggaatttttacatcaacagggagctccatttaaataacaacctgttacgagttctaccttttgagctgggaaaactgtttcagttgcagactttaggcctgaaaggtatgacttccatatttgtacttcttatggtttgtgtatatgtctttgaatctaaagaagccaagaagctttctgctaggggattcttttaaagactcattttcccccagacttcatcagtttcttagctatatcgcaatggttttatcttctctgttcagctgtagactatctactagtctttgttttctttttttttgctccggacccagcccttcttttctagcctctgttttaataaaccctgtgttctggtgatacatccctgaggctatgctttatttcatcatgttataaacagctgtttttcttagattcaaatctcaaaaaacatggagcctctcatatagtacagaaaacaggaagtcgaaaatgttgaccatttgaacctgctgatgatcaagatttaagcatatttaaaaaaacttgatttatgaggacttgtgattatagggccataattgatccagcaagaactattaggaaataaatattttttaagccaacaatattgaaagttatattttgacagtatgtcaatgcctataaattttttatcatgttaagcagttcttcaccagccttgggtaggtgtgtctagcctactgtacagttgcttcttcaaaaaagtcactagatgaagtcgtcaagatttgcacccttaggccgggcacagtggctcacacctgtaatcacaaaactttgggaggctgaggtgggtggatatcttgaggccaagagttcaagaccagcatgagcaacatggcaaaacccaatctctaccaaaaatacaaaagtcagcttggcatggtggttcccacctgtagtaccacctacttgggaggctgaggcatgagacttgcttgaacctgggaagcagaggttgaagtgaggtgacattgtggcattgcactccagcctgggtgacagagcgagactctgtcttaaaaaaaaaaaaaaaaggaattgcactcttagtttcttaaaaatacagttatataaaaggttttagtcctgtaaatattttatatatcataaaagaacagttttttttaaataaatagaaatatatgttttaaaatgtacggaaagtcatattcaacagatatcaacattgtaaatggtttgtaattttttttctgtgtgggctgaactagctaaggcttctaaatataaaggccagtgaaatgcaagatgaagatgcccttttctgttatatttcccagtctagctgtttctaaatttgaagaacagaaaagtactgtgtggcaaagtgtccatatactgactgccagaattaacagtgaatactttatcatttttgtgtataatttttttaatgcaaaagaaatggaacattacagaatgttgagaccctctttgttcttccagtcttcctcatggcggaggtatgtttttccaattcaaggttttcctaatcttacactatatattttacaaactgtaatttgtaattcgtactcactaaggcttttcacaaactttatttgaagttagggtcaccagtcacaaatttgcttttttttttttttgagagagagtctcttgtcgcccaggctagagtgcagtggcatcatgatatcggctcactgcagcctccttctccctggttgaagcaattcttctgcttcagcctcccgagtagctgagattacaggtacccaccaccatgcccagctaattttttgtgtttttagcagagacgagatttcacctgttggctaggctggtctcaaactcctgacctcaagtcatttgccctccttggcctcccaaattgctggggttacaggcgtgagccactgcaccaggccataaattttcatactgatttaatgtacaggaaagcctctaagtgtaaatgcctgcagcagtagggcagttctttatgactccttcatttttgatgatcccttgcttttccatttcagatgctttactttatcacctctagacatctgtgtttatttcttggaagtgtagtttcaaagagacatttgcttatctcacatatcctgctggacagcattacacatctgtaatagcagtcttcttttactggttttacttcctttggacaaatccttttattttttctgagcttttgcagtttacactttaattctaatgttgtgtcggaacattgggtggaatgatccgtttgggggtagagctgctgctttacttcttaaagcaattgtatcatctttgccctctgaaaactatcattgatttctcccggcatccgcttggaagagagaaaataatatcacttagttcagagtcatgtttgtttgctattatacgtcatacattcttgcagaaccaaagtatttctgcctcatgaatcagttcataccattttctttgaagttgttgcagaatggctggcaggcttcactttttccccccacatttttaaatactcttcaaaattgtgccgcagtactacagttaaaggcaggactgtgaccttaggtgcccattcactttttttccttaaactgtttattttgagatacttgtagattcacatgcacttacaagaaataatacagaacaatcctatcccctttacccaactccctccaatagtagcatctttcaaaactatagtttcacgttatcgtacatagaacagtcaagacacagaatattttgtgaaataagccagacacagacaaatacaacatgatctcatttatgtgtgaagtctttaaaagtcaaactcatagaagtagagtgtagaatggttgttcccagaggcttggggacgggggacagagtggaaaggagaggtgttggtcagagggtgcgcagtttcatttacacagggggaataggtctggtgatctgttgcatagcatagtaactatagttaataataatgtgtattttttaacagctaaaagaatggatattaaatgttttcaccacaaataagtattcgaggtggtggatatgttgattagcctgatttgatcattccacaatgcataactgtgtggaaacatcacattgttccccataaacatacacaattatatgtccatttagaaaaggatgtagaacatctctatcaccagaagatccttttgttacactcttatagccacacctactttgttcctgccccagctcactgcttctaagttttgctattttaagaatgctaccatcccgggcgcagtggctcacgcctataatcccagtactttgggaggctgaggcaggcagatcacgaggtcaggggatcgagaccatcctggctaacatggtgaaaccccgtcactactaaaaatacaaaaacaaaattagccaggcatggtggcaggtgcctgtagtcccagctactcgggagactgaggtgggagaatagcgtgaacctgggaggtggaggttgcagtgagccgagatcgtgccactgcactccagcctgggcaacagagcgagactccgtctcaaaaaaaaaaaaaaagaatgctactgaatggaatcatactgtatgcggtcttttgagatgggcttttccactcaggttaattatttggatatttgtcctggttgcatgtattgatagtttgttcctttaaatagacaaaagtagtagtctatgatataaatgtctcgtggttagtttaaccatttacctgctgaaggaaatctgggtggcttctaatttggggctgttacaaataaagttgctgtgaacattcagtgtgcaggttattgtgtgaatatagttattcatttctctaggataaatgtccaggagtgcagttactgggtcatttgagggttgtatatttaattttttaagaaattgctaagtggttttctgtagtgtaagtactgctttacattgtaaagtgattcactttctctgcatcctcaccagcatttggtgttgtgactgtttttatgttagccattctggtagatgtgtagtcatttcatggttttgatttacatttccccaataaagatacccaacatctttgcaggtgcttatttgtcatctgtaatgtttttcttctgtgacatttcttcttgtcattgtccatgttctaattagattatttgcttttttactgggagtcctttatatattctaggtacgagtcgttggtggaatatgtggtttacacatatttctctcagtatgtagctttttacaaggtcattgcacagcaaaagtttttaattttaatgaagcccagtttatcagttttttcttctgtggatcctgattcttgtttcaagtctaagaactctttgaatagctctaagtcccaaagattttcctcttaggttttcttttaaaagttttatggtcttatgttacatttaagtctatgatccattttgacttacgattgagttaaaagatgtgaggattagctcaaggttctttttgtgtgtgtgtggcctgtcgatgtccagttgctccagcagcattattgaaagatgatcttaccttcattgaattgcttttgcatctttggcaaaaatcagttgagcatatctgtgtgaatctgtttctggattttttattctgtttcattgatctatgtgtccatccttccgccaacatctgcaaaaccagttctgaggccccaggaaggaatcggctctttgagcctcagaagggtacagctgtgcgtggccacagggaacacactccaggctactggggtctagtgatgaggcacttttgtcaggacgtggtccacagagaggagaaaagaaatgttctttagtctcagaggccaagacagacgcatgggaggagagggagatggcaaggacctggataactggaggcgtgatgaatggagagtctggtgcaggatccatgccacgggaggaggcccctgtggagagtgagaccttgggcggttagggctggccggactgggccccctgctcctcacagtgtgacctaaagccgcggcctggtatctagtgctttccagcgtagcccaggaaggcgcgccctccttcggcagaaacaccttaaaaaaaaaaacaaaaaacctgctattgctttttagacagaaacaatatggagacttttatttcattgagttctgctctttagtatttccttccttccttcttgtgtttgctttttttttttcctagcttcttgaggcgatagcttagattattgaattgaggcttctgtctttattgagacttttgtcttcatgcatttaatgtagaaattttcctcccaaccctgctttagaagctatgtccagcaacaaattttgatatttgtatttttattttcactagctcagtatattttatttgtttgtttattattttgggacgaggtctggctgtgttacccaggttggcttccgactcttgaggcccaagcaatccccccacctcagcctctgaagcaggtgggactacaagcactttacccccggcttggttctcgatttttaatatgatttcagtgtggtcagaaagtgaacgttctgtgtgatttcaattcttttccatttgttgaagtttgtttgatggcctaggatatggtccatcctggcatatgtttcttgggtactggaaaagaatgtgttttctgtttttgggtagaatgttctataaatatctattagctcctgtatattaacttaatgtctgttaggtcgatggtagtgaggtttttgtcgtgttctgtcagttgtggagagagaagtgttaaagtctccaacaataattgtagactctgttttccttttagttctctcagtttttgcataaaatattttgtgcttctcttgtttggaagcacacttagaattgctgtgtcttcttgagggattgagcctttattattacataatgttattttctatctctggcaattttatttcctctgatgtccactttatctgatattaatataaccactcctgctttcctttgatcaacttttgcattatatatctcttgccattcctttcttgcctctattattacatctgaagtgagtttctgtggacagtatatagttgggtcatatttttaaatccattctaccagtcttttaattggtatatttagaccatttacatttaaagttaattagtaagttagggtgtaagtcgtaagtctgccattttatttttttgttttctgtttcttcatcttttgtctttttctctttgcttctgcctgcctatgggttactgaaacattttttagattccattttgatttttctgtagtggtttgagtgtgtctgtttgtatagatgtttcatggttcctctgggtatcacactagatgtataacttaccacagtctattgggggttattttaccagttcaagggaaatatcaaaccttagctctctttacatccttttattcactgccattgataacagttcagaatattttctttacataaatttagaatcacattagttttatgattttttttttttttttgagacagagtctcgctctgttgcccatgctagagtgcagtggcgcgatctcggctcactgcaagttccgcctcctgggttcaaacgattctcctaccttgccttccaagtagctgggattacaggcacccaccaccatgcccggctaatttttgaattttaatagagacgaggtttcaccatgttggtcaggctggtcttgaactcctgacctcatgatccacccacttcgccctcccaaagtgctgggattacaggtgtgagccaccgtattgggccaaaattttttaaactgtcaaacgtgatttagaaaacttaaggaaatctcgtatttgcccatatttttttgtttacctatattgttttcttcttccaaagtccttcttttatcatttcctttgtatttagagaactttttctagtggttccctttgggtagatctgctggcagcagattctgttagttttttgtcctctgagattgtctttatttctccttcattcctgaaggatgttttcactggatataagaatctgggtttgacagttctttcgacacctgaaaaatattttgctgcttccttctggcttccatggcttatcatgacaaatctttcgtcattccaatttgtttttctcctgcaggtaaggtgtcatttttctccggctgctttcaagatgttttttctttgtctttagttttcagaagtttaattatgatgtgtcttgctgtggattcctttgggtttttcttgtgtaggggttcactgtgcttcttgaatctgttggtttatatttattgccatattgtgagaatcttcagccattattgctttgagtactttttcagccctgtcctccgtgtcctcagcgtccaaggctctgatgacatgaatgttagatcttttgttatagtcccacaagccccagagactttgttctttttgttgttgttggtggtggtggtggtgttggtctgtgttcttatctatctatcaatcaatcagtcaatcaagagacgaggtctcgggctggagtgcagtggcacgatcttggctcactgcagccttgacctcccaggctcaagcagctctcctacctcagcctcccaagtagctgggaccacaggcatgtgccaccatgcctggctagttttgtttgtttgtttgtagagacgagattttgccatgttaacaaagctggtctcgaactcctggcctcaagtgatcctcctgcttcagcctccaaagtgctgggattataggcatgagccactgtgcctagccttcatttattttatttttcagttctaatattcccatttggttttaaatgttttatttgcctgaactttgtttctttgctcagtcttcctgttttcttgtgtgttttgtgtgtgtgtgtgtgtgtgtgtgtgtgtgtgtgtgttttcaagcatgtttttaatttctcattgaagcatttttgtcatgattcctttgtcttggttgggtaattctgtttctgtcatctcagggttggaagttgtgtttatctttttgcatttgatatcttcgtgtcttggtgtgatgagctattttcatttgaaactggactcactcatgttatgaaactctagatcttgtttaaaccctttagtttggttttctttgcctagcactgctgtgacaagggaaccaggcactgtctccttactgccagtggaggtagaagttcaggttccacttggccttcgctgacacctgggagtgggggctcctcgttgcttctggtggaggtggtagttttggctcttcacgcggcctccacaggcaccgcactggcgtgtcctctttattgcagggagatggtgaaagtcttgactctccttggcctcctctgacaccacctcagagggaggaagggagctccatatcgcctcctttctttctcttgcagcagaagtctaccagcctctccacttgctcatgctggcatgggtagagatgggaccacgtttttttctttagtgttaagcttgagtacagtggttcttatctaaaacttttgtccttttaggcagcccttccctggtcctttggcttttgttgggattcttttgggtctgtacccattggtatttccatgttactggcttcttagctgcatgtctggcatatctgaggcaaaaagtgaacccagggaactcatccctgtgccgttcgtcaggtcctgcagtctttggctattctgccttctctccttttttcagagttttgtgtttgctttacacataatatacagtgcttttagttgtacctagtgggaagaatagggaaaagtgtttttactccatctaccctaaagtaacttctcatttacttttttgttctttctcaggactcagtatagttttaattccagaattttattgttattgactttattcatatatattgttttctgtttccaagtagtgaagagcagattaattttcaatttaaaagaagtcctggccgggcgcggtggctcacacctgtaatcccagcactttgggaggccgagtcgggtggatcacgaggtcaggagattgagaccatcttggctaatgcggtgaaaccctgtctctactaaaaatacaaaaaattagccgggcatggtggcagctgcctgtagtcccagctacctgggaggctgaggcaggagaatggcgtgaacccgggaggcggagcttgcggtgagccgagatggtgccactgcactccagcctgggcaacagagcgagactccatctcaaaaaaaaaataagaaaaagaaaacagcatcactgtaggtctggttagaatgagctgtttacctgataccgagaagttttcagttgacttcattttctcaagatgtgtttcacaaagggtcctgataagcttcaggttgtaactgcttatctcacgggattgtgactcagtgaaaacatgaaaaggctgtggtgggtataaagaaccacacacacgtgagagaatggtactcttgtaattgccttcctgcaaatacctactttgcacttagagcagcacatttttctttttataattcttagaatcctagaatcttaaaaccgaaagatcttaaagataaatgaactttgccatttttcccatccatgcaactcagcttctttgaaggatactccactgcctcacagcacagggtgtctcaaatagttaacagtgtttgccaacctcttctattcggccttggcctttcctgttaaatttttttttttttttttgagacagagtctcgctctgttgcccaggctggagtgcagtggcgcgatcttggctcactgcaagctctgcctcccaggttcacgccattctcctgcctcagcctcctgagtagctggactacaggcgcccgccaccacgcctggctgtttttttttgtttgtttttgctttttttttcttttatatttttagtagagacgaggtttcaccgtgttagccaggatggtctcgatctcctaacctcgtgatccgcccgcctcggcctcccaaagtgctgggattacaggcatgtcttccttctgctctttgagtccagtcttttatgagagaataggaaaaaacacttcctttaggttttgatcattcttatctaccatatcctttagtttttcttcatttggtatggttaacatctttgaccattttatctgccttcttcaaactgcagaatttgtctggttttcttaaaatggcgctgtggcatccagaataatacacaatgcttgtgtaggatggataggaactttgctccatgaaaccctgcgctgcactgttgttatttgtacttttatttctcatgtacataagaaacccttctgagaggatttgagattcttgtaggtatatgtaaatcattgtttttgctctcattttggaacaaagcagttattgaatttacagatggctcatggccctgggattttttccccctccttagtgagttaattcttaagccaagtcagccccattttgttgctttgttcagtatgactttaaaaaatctaagtgcaagtgtatatttgtcattagggtgttttgttgttagctttgtgacattgtagagttttgattctctgatgcattacgctggctttcatccttcccttcactgtttcctctgcccacccactctcccagtcacctgcctgccccgttcgtgttttgctcactcttgtttgttataaccatctgtattattgaaagtgttggcaaggcagggtcagatatagagcactgctagtgcatttctgattgacatcagcccattaacattatgttttgaatgtgtatatagaacatggtatgaatcatttttacttatatcagaaactgaaaaaacaatattttctatagtctgacatcttactagtaactataacatagttatggatgatctgataattttgatacattttaaaattttgaaacattttattacttagtttcattttacttatttcaaaaatatttccaggaaatccccttacccaggatatattgaacctttatcaggaaccagatggaacaagacggctgctgaactatttgcttgataatttgtcaggtactgcaaaaagaagtaagtggttatttgtttaaacctttttattaggaagacgtgtaagaatattgcttaattctgtattttctattcaactagttacaacagaacaaccacctccaaggtcttggattatgttacaagaaccagataggacaaggccaactggttggtagtcttttattttttaactgttatttttgctcagtctctataagcctaacagtattgtcagcatgcttagattacaggtagcattaagacaaaatgtttaaggttggtttggtttgggaggtaataaaaaagaattcttgctcacatgacctctatgtatactacattgtgctatatagaaagtgtgctataaagcagtgcttctcaaacgggcagtttatcccccagaggacatttggcaatgtctggagacaattttgatggtcgtaactggggagaagtgctgctggcgtctggtggatggaggccagggttgctgctcagcattctatagtacacggcacaggcccccacaacagacttcacctgaaatgtcagtagtgcgactctggttgagaaacccttctgtagtgtactgatgaaattcacttaaaatgaatacacccaaatttttctctatgagaagtttccaaatcctagcatgttccaaatggatttgacactaccgagttataagagagccaaacccttacttagaggaaagtggaactaatgactgctcatctccttttaacctaaattctatgtaaatagtttgggagctttcatggtgcgtgtaacaaaatttggtctgtgataccgttttcattttgcatgaattaacaatagttgtgctgtagaagaaaatgaggcatgcctattaaggatactacctatccagtttccacatcttacattaacagttggtagcatggtagaaggagtatagaaatgaggaatgttaggctcagagactgaagggctcacgagcttagacttttcacttccagaccttctgtgcctacctctgtagcaggtagtacattgtattctaacttgttcacttatctatcctgcttgcattatccgtcttttatttatcccccatatgtggcgtacagtagcttttcagtgactatagattgaatgaatacggtcaaacttaacatttaagtgaaaaccattactgaaattaattatatatttttttctgccacatgtgtgaataagtaaagttatctttcctacagccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggtaagtcagacagaagacagtcaacctagcattgataaaggaaggagcaactaggaatacattacgctgacacatttgaagttttagcttcagtagttcttaaagtactgcttttttctgttattagtgaatcctgggagtactgcctgctttgctttgcagtgctatgttgcaaaataggcaaatgtgttaagctgggatttatgcgtttgccatgaccgctaaatactcaccttcctcctccctccagcgtccctgcactatttttgaattgggtggcaaagttactgaaattctagcgtggtcaagctataacttgcattgccgaccatgttgctagaacaattaaggcaccgtgtaaaaaggactgacttggtacacgaacattttgggttctcagtgcaactctcatagtcactcatatgatcttgaacatgttactttctgcccaagggtctgaagttatgatttgtaaagttcgtcgacctctgtggttcttgttccacctcagttctaagacataaggaaatacacatgcatagaagtgtgtctttcactcactgttcttaaacaacaatgagttgcccttggtacctagtacctgtaaaatgacaagtcgctgttccagttggtttcagataaatagtgttgaaaagatgttactttttttttttttttttttttttttttgggtggtggggagacaggctctttctctgtcccccaggctggaatgcagtggcatgatctcagctcactgcaacctccgcctcctgggttcaagtgattctcagcctccgtagtagctgggattacaggcatgcaccaccatgcctggctaatttttgtatttttagtagagatggggtttcgccatgttggccaggcttggtctggaactcctgggctctagtgatccgcccgcctcggcctctcaaagtgctggggttacagacatgagccaccatgcccggcccggaaagatgttacattctttaatctgcagaccagtcctttgaaattatttcaagctctcaaactatacatagaagttaatatgcagactaatttttgtcttatgaaataactgtgctgtttacaacttttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaagtaagtcatcttattttttaaaaagaacgttttctcagtatttgcagggtgggggccaagggtgtggaaactaattggcaaatgagagaatgaggcactatattattactgaagcaaagaatactgtttgacctagggggtttttgtttgtttttaatcatcagaaataaccttgttttggagacatgcttaaagtactgctgtttcttcaggtgtttactagggtttaactcccaattgttaattgaaataccatgtagttaaaattccctctatgacggtacagggattcttaaacccatactttagaaaagaattgtttaaaaattacaaggtagaatattccaacataaaacttaaacagaagatgactacattttcttcagttgtaaaaatatttcaagttgttatttgtatcaataacagactgagagcaactttaaatggatgtgggaagcttgatgctgaacgtggaggattttccgtaatgtgatttaagtgccatcgtatctgttaaggaagtttgggaaaactgcgtttcccacaaagctaacctcttggtattcccaactctgtgtgtgtgtgtgtgtgttgtttttgttttagatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtgtgagtgcccttcacttcctgtaaaattgaccagctctgactagacatcttcaaaagaatagaaaacagaaatttcattgtgtattcatggtcttgtctaacacctgaagaaactcagtgagaagttgtctttcctaaaatgtatctctttttctctaccacaaagcttaacatgagaaagcattgcccattaaagtattagaagccttgaaaagcattaaaaaacctttttttttttttttgctcctaagaatttttcatataaaataaatgttgaagtaaatattaattaaaataactgctcaggggtaagaactccatacacttttgtaattttttggcagcaaggatattctgtaagctaacttcttttcctgatctatttaaaataatcattttattagctgggtgtggtggtgggcgcctgtaatcccagctacttgggaggctgagggagagaactgcttgaacctgggaggcagaggttgcagtgagccaagattgtcacactgcactccaacctgggtgacagagtgagactcctcaaaaaataaataaataaataaatataaataaataaatacataaaataattattttaaaggtcttgagttttggataaatggaccacttcaaattgaaagcatatttcaagtgaccattatgctgggagccgaaacttgtgtcacttgaggaacagttggaactggagaaatttaatgtgaagtatagaaaaaatggaaataggacttaacgattgtcttaaatctaagaaagagggtttagatgtaattttgtgaggctcgatttaggacatccaaactaagaccaaaagtttcagggagacagaattttaaaaatcaagctgtcccaaatagggctatttttgtacaagtagtgaatgccctgtgctggaagcatcagcccaggttgagatgtgtatttctcgggtttgttgtagggcacattcagtcatccggtgggaattttaggtgtcttttctattctgggactctgagagattatttgctttcagacgctgtaagaatatatgggctgatgggcgggttttgtctctttctttgtttcgtttttatctaatgtagccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtaagaaaataatgtgattttatgtagaatattttttgacataagatgatttagtaatgttttgtttctgatcattccaaattaagtccaaataaaaattcagtttgtaatggcagctatgagcaggttttaaacatcatgttggggtggaggggccattttgaagatgaaacgatattatggaaacttgaggagaaggatgttaatcatcttgaataaacacataagcaataacgtgaaataactctttaaagaacgtatgtagttccattttattactccaaagtcagagataattatggttattaagacagcctctttgggattccagcgtgtggtaatataatcatagtttaaatttgagttaaaattatagaatctcaattttgcatgtatttataacttgattagaaaaatacacctcaggtggaaaatgagctcctttatttgcacacatatcagtcaagcgattttgacaaagagcaaggatcttgatttttattaaaatgtagaatacagaaagcctgatctggagcgctctttccgtggatagtatacaataaacagtagcccttgtaataacaaactgtttctttctttttgtgtttcaactcatttatacacacaggaatactcttccttggacgtgaatgtacgcatgaacacacacacacgcacatttggaagcacgttcttgacatcacaatagatagagcccttaggaagaaagaaactggctgggtgccgtggctcacgcccgtaatcccagcactttggggggcccaggtgggcagatcagttgaggccagcagttcgagaccaacctggccaacatggtgaaaccccatctgtactgaaaatacaaaaattagccaggcgtggtggtgcacgcctgtaatcccagctactcgggaggctgaggcacaagaatgacttgaaccccagaggcagaagttgcagggagccaagattgtaccactgcacttcagcctgggtgacagaacgagactataaataataataatatgataataaaagagagagaaagaaaaactgagttaaaattcaatttcagggaaaatcaaagctatctgaaatctgtaattatttcatctcatcaagttatctggggattactgcccctgaagcagttgagtagtagtctctgacaatttctctacatgctttctactttctgtgtagctacaaagtatctgaggagtaaagagaaaatctggtcaaacattaatatccaagacccatttcagcattgagaaatacagtattataatagcaggcaggtcagaaaatgtccagccttgctaatttgtgaataaaatgtaaatgaaagtatattttcatagcccatcttatgcttagtaaattgggaaaatacttcaccagggatgtggacgtttggcctgtaactagctggtggtattctcttccatagttggcagcattataaaatggcacattcagtcctaatcttgggattttataccaagtaaataattgagcgtaagccagaagtctgcatactaagatgctgatcgtggtgttatctttaattctttgtaaaaagtggaaacaacctgcattttacaaaataagtaaccagtaaatattatccaccagcccaattgcattgtgcagccattaaagaacgataattgggaagacacatgttcataaagcaaattataaactattcaatactctgtgatgacaactgtgtaaaaatagatttgggcaagtcctggcaaatgtaaaaggaaacattttggaacgtgggaatatgtatagtttaaaacttcttactattgcatgatcttttaaaattactttttgtatatatttgacaataaaaaaatttgtcttcattgtaggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaaggtgtgtcttgagactgataagcttttcaaacctgtcttttactggcaggtgttctgatacatcattatgtctttaaaactgtggctgtgtgttcaggctggaatgaagcagtcttgaattcattgacagcaatgttctttgttttttgtttgagacaaggtctcactctgttacccaggctggagtgcagtggcacagtgatggctcactgcagcttcaaccatgccggctcaaacgatcctctcacctcggcctccctagtagctgggactacaggcgcctactaccacgcctggctaattcttgtattttttgtagagatggggtctcgctatgcccaggctgatcttgaactcctggcctcaaatgattcttccacctcagcctcccagtgtgctgggattacaggcgtgaaccactgtgctcagccagtaatattcttttattactcttttttagaagtccatgtgatcagtgtcacatccttactttgtagatatttattctaataattttcaggataagaagtcacatgaaataatctgtaaaattcctaagttgactttttcaccttttggggacaattatgtttcttatattctcattactaatagctagatatgcagcaccataattatctagtttgagtggcatttgtggtaagatgttccttctcttacattttaatttaactgaaagtaaactcttgcatgccaaaatgtgatttatattagctatttttaagtgtttctaagatacatcttttttctccccctagagacagtcttgctctgttgcccaggctggagtgcagtggcgtgatctcggctcactgcaacctccacctcccaggttcaagtgattctcatacctcagcctcccaagtagctgggattacaggcatgagccacctcacctggctaatttttgtatctttggtagagacggagtttcaccatgttggccaggctggtcttgaatacctggcctcaagtgatccacccaccttggcctcccaaagtgctgggattacaggcatgagccaccgcacctggtcagacttacaccatttttaacgttagtgattgtttagggctgtcactttcttgtgttcaactgtcctttttctaaaaagagatatggtctcactcattttgcccaggctgaagtacagtgatgtgatgataacacactgcagcctcaaactctcgggctcaggcaaccctcctgcctcagcctccccgctaacttggactacaggtgtccgccgccatacccagatcttttttttttggtaattttttgtaaagacaaggttttgctatattgcccagcccaatcttgaacccctggcctcaagcaatcctcctgccttagcctcccaaagtgctgggattatagacgggagctaccacatctggctcagctgcccttttaaactactttttgcatttctgctttcttaaaaatttcttaactcccagctttctatttctaagctgctggaaaagtaatcatttagattagactgtcagagtgtaaataagagtttagatagtatctcaggagcctttgcaccttagagcatagaaagtaaacccctgtttatcctcaggtgccccttcctttcaggttcttcaggagacattgaagagaaagcatgggtagcagccacagagtgggaatgcttagcgttttctttctctttctgttgctgatgcagtggcaggaagaagacacttgaatgtgcttcagtacatttggccaagagcatgtagaggggaggaccagaaccatcagatgggaacagtttagtagatgccatggcggggtgctgctgagagaaaagggggtcaggtagagacagtcctgccctcatggagctgaggtgtgatgagagagacaagtctcaaccacacaaatgagtagataattacaccttgagatggccattagcaagggaagtgaatctgtggtgagaggtagggtagtaagtaggtaggagcaggattcaggaaggtctttggaaagcagttgaacctgacattgaaagattaagaaggaattgacctcataacaagtagaagaaagtgttccaggcagaatggtggaggggggcagtgtgtgtgtgtgtgtgtgtgtgtgtgtgtgtgtgtgtgtgtgtgtgtgtccgtccgtccgtccgtcctggggcaggaaagaacttggtacctataggtcccctcacatcctcacccctttctcattccaaaggctagtgtggaagcagggaaagtggcacaaattaggctaggaaagagaagcagaggctgcatcctgaaaggccttttaggtcttgttaaagatccagataagaagaatgcttcattctgctagatttgacattttgcacggggaccatttggtgtatgtagtacagacctcatcctacaagctagtaagtttcacttgttctgttctgttcaccaaacatgacataaaggcatgtcttgaaagcactgaggattttagtgttgtcttatacggtgcttatctttttttctgttgtttttcagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaa

We claim:
1. A method for detecting and treating androgen-independent prostate cancer, comprising:
  a) obtaining a biological sample from a subject, wherein said subject has or is suspected of having prostate cancer,
  b) determining a first gene expression level of ATPAF1 in the biological sample,
  c) comparing the first gene expression level determined at step b) with a reference value, wherein the reference value is determined in regard to a second gene expression level of ATPAF1 measured in samples taken from one or more healthy subjects,
  d) detecting prostate cancer wherein a detected first gene expression level of ATPAF1 that is higher than the reference value indicates that the subject has androgen-independent prostate cancer, and
  e) administering to said subject determined to have androgen-independent prostate cancer a treatment selected from the group consisting of surgery, radiation therapy, hormone therapy, ultrasound therapy, and chemotherapy.

2. The method according to claim 1, wherein step b) further comprises
measuring the expression level of at least one or more of PTRF, MEX3D, TRPM4, GLYATL1, STRA13, WHSC1, ARFGAP3, FAM83H, CLDN7, CNOT6, GCOM1, PTRF, OBSCN, FLNA, B3GNT6, and KDM2A in said sample.

3. The method according to claim 1, wherein step b) includes ten or more cycles of PCR amplification of the gene.

4. The method according to claim 1, wherein said biological sample is a tumor sample.

5. The method according to claim 1, wherein said subject has had a prostatectomy.

* * * * *